US008568719B2

(12) United States Patent
Williamson et al.

(10) Patent No.: US 8,568,719 B2
(45) Date of Patent: Oct. 29, 2013

(54) ANTIBODIES AGAINST HUMAN RESPIRATORY SYNCYTIAL VIRUS (RSV) AND METHODS OF USE

(75) Inventors: Robert Anthony Williamson, La Jolla, CA (US); Jehangir Wadia, San Diego, CA (US); Gabriel Pascual, La Jolla, CA (US); Elissa Keogh, San Diego, CA (US)

(73) Assignee: Crucell Holland B.V., Leiden (NL)

( * ) Notice: Subject to any disclaimer, the term of this patent is extended or adjusted under 35 U.S.C. 154(b) by 344 days.

(21) Appl. No.: 12/806,498

(22) Filed: Aug. 13, 2010

(65) Prior Publication Data

US 2011/0076268 A1 Mar. 31, 2011

Related U.S. Application Data

(60) Provisional application No. 61/274,395, filed on Aug. 13, 2009.

(51) Int. Cl.
*A61K 39/395* (2006.01)

(52) U.S. Cl.
USPC .................................... 424/133.1; 530/387.1

(58) Field of Classification Search
None
See application file for complete search history.

(56) References Cited

U.S. PATENT DOCUMENTS 4,391,904 A 7/1983 Litman et al.
4,444,887 A 4/1984 Hoffmann
4,472,509 A 9/1984 Gansow et al.
4,474,893 A 10/1984 Reading
4,714,681 A 12/1987 Reading
4,716,111 A 12/1987 Osband et al.
4,751,180 A 6/1988 Cousens et al.
4,816,397 A 3/1989 Boss et al.
4,816,567 A 3/1989 Cabilly et al.
4,880,078 A 11/1989 Inoue et al.
4,925,648 A 5/1990 Hansen et al.
4,935,233 A 6/1990 Bell et al.
4,946,778 A 8/1990 Ladner et al.
4,980,286 A 12/1990 Morgan et al.
4,997,764 A 3/1991 Dalla Favera
5,021,236 A 6/1991 Gries et al.
5,112,946 A 5/1992 Maione
5,128,326 A 7/1992 Balazs et al.
5,223,409 A 6/1993 Ladner et al.
5,225,539 A 7/1993 Winter
5,258,498 A 11/1993 Huston et al.
5,290,540 A 3/1994 Prince et al.
5,314,995 A 5/1994 Fell, Jr. et al.
5,336,603 A 8/1994 Capon et al.
5,349,053 A 9/1994 Landolfi
5,359,046 A 10/1994 Capon et al.
5,359,681 A 10/1994 Jorgenson et al.
5,403,484 A 4/1995 Ladner et al.
5,427,908 A 6/1995 Dower et al.
5,436,146 A 7/1995 Shenk et al.
5,447,851 A 9/1995 Beutler
5,457,035 A 10/1995 Baum et al.
5,516,637 A 5/1996 Huang et al.
5,530,101 A 6/1996 Queen et al.
5,565,332 A 10/1996 Hoogenboom et al.
5,571,698 A 11/1996 Ladner et al.
5,573,920 A 11/1996 Randle
5,580,717 A 12/1996 Dower et al.
5,585,089 A 12/1996 Queen
5,601,819 A 2/1997 Wong et al.
5,605,793 A 2/1997 Stemmer
5,622,929 A 4/1997 Willner et al.
5,658,727 A 8/1997 Barbas et al.
5,667,988 A 9/1997 Barbas et al.
5,679,377 A 10/1997 Bernstein et al.
5,698,426 A 12/1997 Huse
5,723,125 A 3/1998 Chang et al.
5,731,168 A 3/1998 Carter et al.
5,733,743 A 3/1998 Johnson et al.
5,750,753 A 5/1998 Kimae et al.
5,762,905 A 6/1998 Burton et al.
5,780,225 A 7/1998 Wigler et al.
5,783,181 A 7/1998 Browne et al.
5,807,715 A 9/1998 Morrison et al.
5,811,238 A 9/1998 Stemmer et al.
5,811,524 A 9/1998 Brams et al.
5,821,047 A 10/1998 Garrard et al.
5,824,307 A 10/1998 Johnson et al.
5,830,721 A 11/1998 Stemmer et al.
5,834,252 A 11/1998 Stemmer et al.
5,837,458 A 11/1998 Minshull et al.
5,840,298 A 11/1998 Brams et al.
5,840,300 A 11/1998 Williams et al.
5,844,095 A 12/1998 Linsley et al.

(Continued)

FOREIGN PATENT DOCUMENTS

EP 367166 A1 5/1990
EP 394827 A1 10/1990

(Continued)

OTHER PUBLICATIONS

Rudikoff et al. Proc Natl Acad Sci USA 1982 vol. 79 p. 1979.*
MacCallum et al. J. Mol. Biol. (1996) 262, 732-745.*
Pascalis et al. The Journal of Immunology (2002) 169, 3076-3084.*
Casset et al. BBRC 2003, 307:198-205.*
Vajdos et al. J. Mol. Biol. (2002) 320, 415-428.*
Chen et al. J. Mol. Bio. (1999) 293, 865-881.*
Wu et al. J. Mol. Biol. (1999) 294, 151-162.*
Padlan et al. PNAS 1989, 86:5938-5942.*
Lamminmaki et al. JBC 2001, 276:36687-36694.*
PCT International Search Report, PCT/US2010/045549 dated Nov. 23, 2010.
PCT International Preliminary Report on Patentability, PCT/US2010/045549 dated Feb. 23, 2012.

*Primary Examiner* — Laura B Goddard
*Assistant Examiner* — Meera Natarajan
(74) *Attorney, Agent, or Firm* — TraskBritt

(57) ABSTRACT

Provided herein are antibodies or antigen-binding fragments thereof that immunospecifically bind to the fusion (F) protein of Respiratory Syncytial Virus (RSV). Also provided are methods for of prevention, treatment and diagnosis of viral infection and/or the treatment of one more symptoms of RSV-mediated disease. Methods of generating antibodies that immunospecifically bind RSV F protein also are provided.

12 Claims, No Drawings

(56) References Cited

U.S. PATENT DOCUMENTS

| | | | |
|---|---|---|---|
| 5,855,913 | A | 1/1999 | Hanes et al. |
| 5,874,064 | A | 2/1999 | Edwards et al. |
| 5,908,626 | A | 6/1999 | Chang et al. |
| 5,912,015 | A | 6/1999 | Bernstein et al. |
| 5,916,597 | A | 6/1999 | Lee et al. |
| 5,934,272 | A | 8/1999 | Lloyd et al. |
| 5,955,364 | A | 9/1999 | Brams et al. |
| 5,969,108 | A | 10/1999 | McCafferty et al. |
| 5,985,309 | A | 11/1999 | Edwards et al. |
| 5,985,320 | A | 11/1999 | Edwards et al. |
| 5,989,463 | A | 11/1999 | Tracy et al. |
| 6,019,968 | A | 2/2000 | Platz et al. |
| 6,136,310 | A | 10/2000 | Hanna et al. |
| 6,413,771 | B1 | 7/2002 | Brams et al. |
| 6,537,809 | B2 | 3/2003 | Brams et al. |
| 6,656,467 | B2 | 12/2003 | Young et al. |
| 6,685,942 | B1 | 2/2004 | Burton et al. |
| 6,759,518 | B1 | 7/2004 | Kontermann et al. |
| 6,818,216 | B2 | 11/2004 | Young et al. |
| 7,070,786 | B2 | 7/2006 | Scallon |
| 7,083,784 | B2 | 8/2006 | Dall'Acqua et al. |
| 7,217,797 | B2 | 5/2007 | Hinton et al. |
| 7,364,737 | B2 | 4/2008 | Burton et al. |
| 7,364,742 | B2 | 4/2008 | Scallon |
| 7,488,477 | B2 | 2/2009 | Pilkington et al. |
| 7,879,329 | B2 | 2/2011 | Lantto |
| 2004/0234528 | A1 | 11/2004 | Burton et al. |
| 2005/0019758 | A1 | 1/2005 | Deen et al. |
| 2005/0175986 | A1 | 8/2005 | Gross et al. |
| 2005/0288491 | A1 | 12/2005 | Wilson et al. |
| 2006/0013824 | A1 | 1/2006 | Scallon |
| 2006/0024298 | A1 | 2/2006 | Lazar et al. |
| 2006/0159695 | A1 | 7/2006 | Delvecchio et al. |
| 2006/0198840 | A1 | 9/2006 | Dall'Acqua et al. |
| 2007/0082002 | A1 | 4/2007 | Brams et al. |
| 2008/0226630 | A1 | 9/2008 | Lantto et al. |
| 2008/0287657 | A1 | 11/2008 | Hinton et al. |
| 2009/0092609 | A1 | 4/2009 | Crowe, Jr. |
| 2009/0110684 | A1 | 4/2009 | Pilkington et al. |
| 2009/0137003 | A1 | 5/2009 | Tolstrup et al. |

FOREIGN PATENT DOCUMENTS

| | | | |
|---|---|---|---|
| EP | 307434 | A1 | 9/1993 |
| EP | 307434 | B1 | 9/1993 |
| EP | 307434 | B2 | 9/1993 |
| EP | 396387 | A2 | 12/1993 |
| EP | 396387 | A3 | 12/1993 |
| EP | 396387 | B1 | 12/1993 |
| EP | 239400 | A2 | 8/1994 |
| EP | 239400 | A3 | 8/1994 |
| EP | 239400 | B1 | 8/1994 |
| EP | 592106 | A1 | 11/2004 |
| EP | 592106 | B1 | 11/2004 |
| EP | 519596 | A1 | 2/2005 |
| EP | 519596 | B1 | 2/2005 |
| WO | 8801642 | A1 | 3/1988 |
| WO | 8912624 | A2 | 12/1989 |
| WO | 9002809 | A1 | 3/1990 |
| WO | 9100360 | A1 | 1/1991 |
| WO | 9102795 | A1 | 3/1991 |
| WO | 9106570 | A1 | 5/1991 |
| WO | 9109115 | A1 | 6/1991 |
| WO | 9109967 | A1 | 7/1991 |
| WO | 9110737 | A1 | 7/1991 |
| WO | 9110741 | A1 | 7/1991 |
| WO | 9114438 | A1 | 10/1991 |
| WO | 9201047 | A1 | 1/1992 |
| WO | 9205793 | A1 | 4/1992 |
| WO | 9206180 | A1 | 4/1992 |
| WO | 9208495 | A1 | 5/1992 |
| WO | 9208802 | A1 | 5/1992 |
| WO | 9218619 | A1 | 10/1992 |
| WO | 9219244 | A2 | 11/1992 |
| WO | 9220316 | A2 | 11/1992 |
| WO | 9222324 | A1 | 12/1992 |
| WO | 9222635 | A1 | 12/1992 |
| WO | 9311236 | A1 | 6/1993 |
| WO | 9314188 | A1 | 7/1993 |
| WO | 9317715 | A1 | 9/1993 |
| WO | 9320221 | A1 | 10/1993 |
| WO | 9408598 | A1 | 4/1994 |
| WO | 9515982 | A2 | 6/1995 |
| WO | 9520401 | A1 | 8/1995 |
| WO | 9604388 | A1 | 2/1996 |
| WO | 9622024 | A1 | 7/1996 |
| WO | 9633735 | A1 | 10/1996 |
| WO | 9634096 | A1 | 10/1996 |
| WO | 9640252 | A1 | 12/1996 |
| WO | 9713844 | A1 | 4/1997 |
| WO | 9732572 | A2 | 9/1997 |
| WO | 9734631 | A1 | 9/1997 |
| WO | 9744013 | A1 | 11/1997 |
| WO | 9816654 | A1 | 4/1998 |
| WO | 9824893 | A2 | 6/1998 |
| WO | 9831346 | A1 | 7/1998 |
| WO | 9846645 | A2 | 10/1998 |
| WO | 9850433 | A2 | 11/1998 |
| WO | 9904813 | A1 | 2/1999 |
| WO | 9915154 | A1 | 4/1999 |
| WO | 9920253 | A1 | 4/1999 |
| WO | 9966903 | A2 | 12/1999 |
| WO | 2005063816 | A2 | 7/2005 |
| WO | 2008106980 | A2 | 9/2008 |
| WO | 2011020079 | A1 | 2/2011 |
| WO | 2012006596 | A1 | 1/2012 |

* cited by examiner

ANTIBODIES AGAINST HUMAN RESPIRATORY SYNCYTIAL VIRUS (RSV) AND METHODS OF USE

RELATED APPLICATIONS

Benefit of priority is claimed to U.S. Provisional Application Ser. No. 61/274,395 entitled "ANTIBODIES AGAINST HUMAN RESPIRATORY SYNCYTIAL VIRUS (RSV) AND METHODS OF USE," filed on Aug. 13, 2009.

This application is related to corresponding International Application No. entitled "ANTIBODIES AGAINST HUMAN RESPIRATORY SYNCYTIAL VIRUS (RSV) AND METHODS OF USE," which also claims priority to U.S. Provisional Application Ser. No. 61/274,395.

The subject matter of each of the above-referenced applications is incorporated by reference in its entirety.

INCORPORATION BY REFERENCE OF SEQUENCE LISTING PROVIDED ON COMPACT DISCS

An electronic version on compact disc (CD-R) of the Sequence Listing is filed herewith in duplicate (labeled Copy #1 Replacement and Copy #2 Replacement), the contents of which are incorporated by reference in their entirety. The computer-readable file on each of the aforementioned compact discs, created on Nov. 19, 2010, is identical, 603 kilobytes in size, and titled 1152SEQ.002.txt.

FIELD OF THE INVENTION

Provided are antibodies and antigen-binding fragments thereof that immunospecifically bind to the F protein of Respiratory Syncytial Virus (RSV) and/or to RSV and/or neutralize RSV. Also provided are diagnostic and therapeutic methods that employ anti-RSV antibodies and antigen-binding fragments thereof. The therapeutic methods include administering the provided anti-RSV antibodies or antigen-binding fragments thereof for the prevention or treatment of a RSV infection and/or amelioration of one or more symptoms of a RSV infection, such as infections in infants and infections associated with organ transplantation. Combinations of a plurality of different anti-RSV antibodies and antigen-binding fragments thereof provided herein and/or with other anti-RSV antibodies and antigen-binding fragments thereof can be used for combination therapy. Compositions containing the mixtures of anti-RSV antibodies and antigen-binding fragments thereof also are provided.

BACKGROUND

Respiratory syncytial virus (RSV) is the leading cause of severe respiratory illness in infants and young children and is the major cause of infantile bronchiolitis (Welliver (2003) *J Pediatr* 143:S112). An estimated 64 million cases of respiratory illness and 160,000 deaths worldwide are attributable to RSV induced disease. In the United States alone, tens of thousands of infant hospitalizations are due to infections by paramyxoviruses, such as RSV and parainfluenza virus (PIV) (Shay et al. (1999) *JAMA* 282:1440-1446). Severe RSV infection occurs most often in children and infants, especially in premature infants. Underlying health problems such as chronic lung disease or congenital heart disease can significantly increase the risk of serious illness. RSV infections also can cause serious illness in the elderly, individuals with chronic pulmonary disease and immunocompromised adults, such as bone marrow transplant recipients.

Several approaches to the prevention and treatment of RSV infection have been investigated, including vaccine development, antiviral compounds (ribavirin), antisense drugs, RNA interference technology, and antibody products, such as immunoglobulin or intravenous monoclonal antibodies. Intravenous immunoglobulin (RSV-IGIV; RespiGam®) isolated from donors and a monoclonal antibody, palivizumab (SYNAGIS™), have been approved for RSV prophylaxis in high risk children. A vaccine or commercially available treatment for RSV, however, is not yet available. Only ribavirin is approved for treatment of RSV infection. In order to be effective for treatment of RSV infection, high doses, frequent administrations and/or volumes of antibody products, such as RSV-IG and palivizumab, are required due to low specificity. Further, the use of products, such as intravenous immunoglobulin, is dependent on donor availability. Accordingly, there exists a need for additional agents for the prevention or treatment of RSV infections.

SUMMARY

Provided herein are isolated polypeptides, antibodies or antigen-binding fragments thereof for the prophylaxis and treatment of Respiratory syncytial virus (RSV) infection and RSV-mediated diseases or conditions. Also provided herein are isolated polypeptides, antibodies or antigen-binding fragments thereof for the diagnosis and/or monitoring of RSV infection. Provided herein are isolated polypeptides, antibodies or antigen-binding fragments thereof that immunospecifically bind to and neutralize RSV. In some examples, the polypeptides provided herein immunospecifically bind to and neutralize RSV when the polypeptide provided herein is contained in an antibody or antigen-binding fragment. Also provided herein are antibodies and antigen-binding fragments that contain a polypeptide provided herein where the antibody or antigen-binding fragment immunospecifically binds to and neutralizes RSV. The polypeptides, antibodies and antigen-binding fragments provided herein can specifically bind to the F protein as well as neutralize RSV. Provided herein are isolated polypeptides, antibodies or antigen-binding fragments thereof that can neutralize RSV subtypes A and B. Provided herein are isolated polypeptides, antibodies or antigen-binding fragments thereof that immunospecifically bind the F protein of RSV. In some examples the isolated polypeptides, antibodies or antigen-binding fragments thereof provided herein contain a sequence of amino acids set forth in any of SEQ ID NOS: 1-16 and 1627-1628, where the isolated polypeptide immunospecifically binds to RSV fusion (F) protein. In some examples the isolated polypeptides contains a polypeptide having 60%, 65%, 70%, 80%, 90%, 91%, 92%, 93%, 94%, 95%, 96%, 97%, 98%, 99% or more sequence identity to the sequence of amino acids set forth in any of SEQ ID NOS: 1-16, where the isolated polypeptide immunospecifically binds to RSV fusion (F) protein.

Provided herein are isolated antibodies or antigen-binding fragments thereof that immunospecifically bind to Respiratory Syncytial Virus (RSV) fusion (F) protein and/or neutralize RSV and contain a $V_H$ CDR1, which has the amino acid sequence set forth in SEQ ID NO:2 or 1627; a $V_H$ CDR2, which has the amino acid sequence set forth in SEQ ID NO:3; a $V_H$ CDR3, which has the amino acid sequence set forth in SEQ ID NO:4; a $V_L$ CDR1, which has the amino acid sequence set forth in SEQ ID NO:6; a $V_L$ CDR2, which has the amino acid sequence set forth in SEQ ID NO:7; and a $V_L$ CDR3, which has the amino acid sequence set forth in SEQ ID NO:8. In other examples, the isolated antibodies or antigen-binding fragments thereof contain a $V_H$ CDR1, $V_H$ CDR2, $V_H$ CDR3, $V_L$ CDR1, $V_L$ CDR2 and a $V_L$ CDR3 having 60%, 65%, 70%, 80%, 90%, 91%, 92%, 93%, 94%, 95%, 96%, 97%, 98%, 99% or more sequence identity to the sequence of amino acids set forth in any of SEQ ID NOS:2-4, 6-8 and 1627. Provided herein are isolated anti-RSV antibodies or antigen-binding fragments thereof that immunospecifically binds to the same epitope on a RSV F protein or on a RSV virus as an antibody or antigen-binding fragment thereof that contains a $V_H$ CDR1, which has the amino acid sequence set forth in SEQ ID NO:2 or 1627; a $V_H$ CDR2, which has the amino acid sequence set forth in SEQ ID NO:3; a $V_H$ CDR3, which has the amino acid sequence set forth in SEQ ID NO:4; a $V_L$ CDR1, which has the amino acid sequence set forth in SEQ ID NO:6; a $V_L$ CDR2, which has the amino acid sequence set forth in SEQ ID NO:7; and a $V_L$ CDR3, which has the amino acid sequence set forth in SEQ ID NO:8 or an isolated antibody or antigen-binding fragment thereof comprising a $V_H$ CDR1, $V_H$ CDR2, $V_H$ CDR3, $V_L$ CDR1, $V_L$ CDR2, and a $V_L$ CDR3 having 60%, 65%, 70%, 80%, 90%, 91%, 92%, 93%, 94%, 95%, 96%, 97%, 98%, 99% or more sequence identity to the sequence of amino acids set forth in SEQ ID NOS:2-4, 6-8 and 1627.

In some examples, an isolated antibody or antigen-binding fragment thereof provided herein contains a heavy chain, which has the amino acid sequence set forth in SEQ ID NO:1. In some examples, an isolated antibody or antigen-binding fragment provided herein contains a $V_H$ domain, which has the amino acid sequence set forth as amino acids 1-125 of SEQ ID NO:1. In some examples, an isolated antibody or antigen-binding fragment thereof provided herein contains a light chain, which has the amino acid sequence set forth in SEQ ID NO:5. In some examples, an isolated antibody or antigen-binding fragment provided herein contains a $V_L$ domain, which has the amino acid sequence set forth as amino acids 1-107 of SEQ ID NO:5. In a particular example, the isolated antibody or antigen-binding fragment thereof is 58c5.

Provided herein are isolated anti-RSV antibodies or antigen-binding fragments thereof that contain a variable heavy ($V_H$) chain and a variable light ($V_L$) chain, where the antibody or antigen-binding fragment immunospecifically binds to the same epitope on a Respiratory Syncytial Virus (RSV) fusion (F) protein as an antibody or antigen-binding fragment that contains a heavy chain set forth in SEQ ID NO:1 and a light chain set forth in SEQ ID NO:5.

In some examples, an isolated antibody or antigen-binding fragment thereof provided herein contains a $V_H$ complementary determining region 1 (CDR1), which has the amino acid sequence set forth in SEQ ID NO:2 or 1627. In some examples, an isolated antibody or antigen-binding fragment provided herein contains a $V_H$ CDR2, which has the amino acid sequence set forth in SEQ ID NO:3. In some examples, an isolated antibody or antigen-binding fragment provided herein contains a $V_H$ CDR3, which has the amino acid sequence set forth in SEQ ID NO:4. In some examples, an isolated antibody or antigen-binding fragment thereof provided herein contains a $V_H$ CDR1, which has the amino acid sequence set forth in SEQ ID NO:2 or 1627; a $V_H$ CDR2, which has the amino acid sequence set forth in SEQ ID NO:3; and a $V_H$ CDR3, which has the amino acid sequence set forth in SEQ ID NO:4.

In some examples, an isolated antibody or antigen-binding fragment thereof provided herein contains a $V_L$ CDR1, which has the amino acid sequence set forth in SEQ ID NO:6. In some examples, an isolated antibody or antigen-binding fragment provided herein contains a $V_L$ CDR2, which has the amino acid sequence of the $V_L$ CDR2 is set forth in SEQ ID NO:7. In some examples, an isolated antibody or antigen-binding fragment provided herein contains a $V_L$ CDR3, which has the amino acid sequence set forth in SEQ ID NO:8. In some examples, an isolated antibody or antigen-binding fragment provided herein contains a $V_L$ CDR1, which has the amino acid sequence set forth in SEQ ID NO:6; a $V_L$ CDR2, which has the amino acid sequence set forth in SEQ ID NO:7; and a $V_L$ CDR3, which has the amino acid sequence set forth in SEQ ID NO:8.

In some examples, an isolated antibody or antigen-binding fragment provided herein contains a heavy chain, which has the amino acid sequence set forth in SEQ ID NO:9. In some examples, an isolated antibody or antigen-binding fragment provided herein contains a $V_H$ domain, which has the amino acid sequence set forth in amino acids 1-125 of SEQ ID NO:9. In some examples, an isolated antibody or antigen-binding fragment provided herein contains a light chain, which has the amino acid sequence set forth in SEQ ID NO:13. In some examples, an isolated antibody or antigen-binding fragment provided herein contains a $V_L$ domain, which has the amino acid sequence set forth in 1-107 of SEQ ID NO:13. In a particular example, the isolated antibody or antigen-binding fragment is sc5.

Provided herein are isolated anti-RSV antibodies or antigen-binding fragments thereof that contain a variable heavy ($V_H$) chain and a variable light ($V_L$) chain, where the antibody or antigen-binding fragment immunospecifically binds to the same epitope on a Respiratory Syncytial Virus (RSV) fusion (F) protein as an antibody or antigen-binding fragment that contains a heavy chain set forth in SEQ ID NO:9 and a light chain set forth in SEQ ID NO:13.

In some examples, an isolated antibody or antigen-binding fragment provided herein contains a $V_H$ In some examples, the isolated antibody or antigen-binding fragment contains a $V_H$ CDR1, which has the amino acid sequence set forth in SEQ ID NO:10 or 1628. In some examples, an isolated antibody or antigen-binding fragment provided herein contains a $V_H$ CDR2, which has the amino acid sequence set forth in SEQ ID NO:11. In some examples, an isolated antibody or antigen-binding fragment provided herein contains a $V_H$ CDR3, which has the amino acid sequence set forth in SEQ ID NO:12. In some examples, an isolated antibody or antigen-binding fragment thereof provided herein contains a $V_H$ CDR1, which has the amino acid sequence set forth in SEQ ID NO:10 or 1628; a $V_H$ CDR2, which has the amino acid sequence set forth in SEQ ID NO:11; and a $V_H$ CDR3, which has the amino acid sequence set forth in SEQ ID NO:12.

In some examples, an isolated antibody or antigen-binding fragment provided herein contains a $V_L$ CDR1, which has the amino acid sequence set forth in SEQ ID NO:14. In some examples, an isolated antibody or antigen-binding fragment provided herein contains a $V_L$ CDR2, which has the amino acid sequence of the $V_L$ CDR2 is set forth in SEQ ID NO:15. In some examples, an isolated antibody or antigen-binding fragment provided herein contains a $V_L$ CDR3, which has the amino acid sequence set forth in SEQ ID NO:16. In some examples, an isolated antibody or antigen-binding fragment provided herein contains a $V_L$ CDR1, which has the amino acid sequence set forth in SEQ ID NO:14; a $V_L$ CDR2, which has the amino acid sequence set forth in SEQ ID NO:15; and a $V_L$ CDR3, which has the amino acid sequence set forth in SEQ ID NO:16.

Provided herein are isolated polypeptides, antibodies or antigen-binding fragments thereof that immunospecifically bind to a portion of a RSV F protein, which has the amino sequence set forth in SEQ ID NO:25. Also provided herein are isolated polypeptides, antibodies or antigen-binding fragments thereof that immunospecifically bind to an RSV F protein, which has the amino sequence set forth in SEQ ID NO:1629.

Provided herein are isolated polypeptides, antibodies or antigen-binding fragments thereof that contain an antigen-binding domain that is a human or a humanized antibody or antigen-binding fragment thereof. In some examples, the isolated polypeptide, antibody or antigen-binding fragment provided herein is a chimeric antibody. In some examples, the isolated polypeptide, antibody or antigen-binding fragment is a single-chain Fv (scFv), Fab, Fab', $F(ab')_2$, Fv, dsFv, diabody, Fd, or Fd' fragment. In some examples, the isolated polypeptide, antibody or antigen-binding fragment provided herein contains a peptide liker. In some examples, the peptide linker contains about 1 to about 50 amino acids.

In some examples, the isolated polypeptide, antibody or antigen-binding fragment thereof provided herein is conjugated to polyethylene glycol (PEG). In some examples, the isolated polypeptide, antibody or antigen-binding fragment provided herein contains a therapeutic or diagnostic agent. Exemplary diagnostic agents include, but are not limited to, an enzyme, a fluorescent compound, an electron transfer agent, and a radiolabel.

Provided herein are isolated polypeptides, antibodies or antigen-binding fragments thereof that contain a protein transduction domain. In some examples, the protein transduction domain is selected from among a peptide having an amino acid sequence set forth in SEQ ID NOS:1529-1600. In some examples, the protein transduction domain is a HIV-TAT protein transduction domain.

Provided herein are multivalent antibodies, containing a first antigen-binding portion containing a polypeptide, antibody or antigen-binding fragment thereof provided herein conjugated to a multimerization domain; and a second antigen-binding portion containing an antigen-binding fragment of an antiviral antibody conjugated to a second multimerization domain. In such examples, the first multimerization domain and the second multimerization domain are complementary or the same, whereby the first antigen-binding portion and second antigen-binding portion form a multivalent antibody. In some examples, the multivalent antibodies provided herein contain 1, 2, 3, 4, or 5 additional antigen-binding portions. Exemplary multivalent antibodies include a bivalent, trivalent, tetravalent, pentavalent, hexavalent, or heptavalent antibodies. The multivalent antibodies provided herein include heterobivalent or homobivalent antibodies. The multivalent antibodies provided herein include multispecific antibodies. In some examples, the multispecific antibody is a bispecific, trispecific or tetraspecific antibody. In some examples, the multivalent antibodies provided herein contain an antigen-binding fragment that is a single-chain Fv (scFv), Fab, Fab', $F(ab')_2$, Fv, dsFv, diabody, Fd, or Fd' fragment. The first antigen-binding portion and/or second antigen-binding portion of the multivalent antibodies provided herein can be conjugated to a multimerization domain by covalent or non-covalent linkage. In some examples, the antigen-binding portion is conjugated to the multimerization domain via a linker, such as a chemical linker or a polypeptide linker. In some examples, the multimerization domain of the multivalent antibody provided herein is selected from among an immunoglobulin constant region (Fc), a leucine zipper, complementary hydrophobic regions, complementary hydrophilic regions, or compatible protein-protein interaction domains. In some examples, the Fc domain is an IgG, IgM or an IgE Fc domain.

In some examples, the multivalent antibodies provided herein contain two or more anti-RSV antibodies or antigen-binding fragments thereof In a particular example, the multivalent antibodies provided herein contain two or more anti-RSV antibodies or antigen-binding fragments thereof.

Provided herein are multivalent antibodies, containing a first antigen-binding portion containing an anti-RSV antibody or antigen-binding fragment thereof provided herein conjugated to a multimerization domain; and a second antigen-binding portion containing an anti-RSV antibody or antigen-binding fragment thereof, selected from among palivizumab, motavizumab, AFFF, P12f2, P12f4, P11d4, A1e9, A12a6, A13c4, A17d4, A4B4, A8c7, 1X-493L1, FR H3-3F4, M3H9, Y10H6, DG, AFFF(1), 6H8, L1-7E5, L2-15B10, A13a11, A1h5, A4B4(1), A4B4L1FR-S28R, A4B4-F52S, rsv6, rsv11, rsv13, rsv19, rsv21, rsv22, rsv23, RF-1, RF-2 or an antigen-binding fragment thereof, conjugated to a second multimerization domain.

Provided herein are multivalent antibodies, containing a first antigen-binding portion containing an anti-RSV antibody or antigen-binding fragment thereof provided herein conjugated to a multimerization domain; and a second antigen-binding portion containing an antiviral antibody that immunospecifically binds an antigen of parainfluenza virus (PIV) or human metapneumovirus (hMPV), conjugated to a second multimerization domain.

Provided herein are combinations, which contain an isolated polypeptide, antibody or antigen-binding fragment thereof provided herein or a multivalent antibody provided herein, and an antiviral agent. In some examples, the antiviral agent is ribavirin. Provided herein are combinations, which contain an isolated polypeptide, antibody or antigen-binding fragment thereof provided herein and an antiviral agent formulated as a single composition or as separate compositions.

Provided herein are combinations, which contain an isolated polypeptide, antibody or antigen-binding fragment thereof provided herein or a multivalent antibody provided herein, and one or more additional antiviral antibodies. In some examples, the combination contains two or more different anti-RSV antibodies or antigen-binding fragments thereof. In some examples, the combination contains two or more different anti-RSV antibodies or antigen-binding fragments selected from among an antibody or antigen-binding fragment provided herein. In some examples, the combination contains an antibody or antigen-binding fragment thereof provided herein and an antibody selected from among palivizumab, motavizumab, AFFF, P12f2, P12f4, P11d4, A1e9, A12a6, A13c4, A17d4, A4B4, A8c7, 1X-493L1, FR H3-3F4, M3H9, Y10H6, DG, AFFF(1), 6H8, L1-7E5, L2-15B10, A13a11, A1h5, A4B4(1), A4B4L1FR-S28R, A4B4-F52S, rsv6, rsv11, rsv13, rsv19, rsv21, rsv22, rsv23, RF-1, RF-2 or antigen-binding fragments thereof. In some examples, the combination contains an antibody or antigen-binding fragment thereof provided herein and an antibody selected from among an antibody or antigen-binding fragment thereof that immunospecifically binds an antigen of parainfluenza virus (PIV) or human metapneumovirus (hMPV). In some examples, the PIV antigen is an antigen of human PIV type 1, human PIV type 2, human PIV type 3, and/or human PIV type 4. In some examples, the PIV antigen is selected from among a PIV nucleocapsid phosphoprotein, a PIV fusion (F) protein, a PIV phosphoprotein, a PIV large (L) protein, a PIV matrix (M) protein, a PIV hemagglutinin-neuraminidase (HN) glycoprotein, a PIV RNA-dependent RNA polymerase, a PIV Y1 protein, a PIV D protein, a PIV C protein, and allelic variants thereof In some examples, the hMPV antigen is an antigen of hMPV type A or hMPV type B. In some examples, the hMPV antigen is an antigen of hMPV subtype A1, hMPV subtype A2, hMPV subtype B1, or hMPV subtype B2. In some examples, the hMPV antigen is selected from among a hMPV nucleoprotein, a hMPV phosphoprotein, a hMPV matrix protein, a hMPV small hydrophobic protein, a hMPV RNA-dependent RNA polymerase, a hMPV F protein, a hMPV G protein, and allelic variants thereof.

Provided herein are combinations, which contain an isolated polypeptide, antibody or antigen-binding fragment thereof provided herein or a multivalent antibody provided herein, and one or more additional antiviral antibodies, where the one or more additional antiviral antibodies is a single-chain Fv (scFv), Fab, Fab', $F(ab')_2$, Fv, dsFv, diabody, Fd, or Fd' fragment.

Provided herein are pharmaceutical compositions containing any isolated polypeptide, antibody or antigen-binding fragment thereof provided herein, any multivalent antibody provided herein, or any combination provided herein and a pharmaceutically acceptable carrier or excipient. In some examples, the pharmaceutical compositions provided herein are formulated as a gel, ointment, liquid, suspension, aerosol, tablet, pill, powder, or nasal spray. In some examples, the pharmaceutical compositions provided herein are formulated for pulmonary, intranasal, or parenteral administration. In some examples, the pharmaceutical compositions provided herein are formulated for single dosage administration. In some examples, the pharmaceutical compositions provided herein are formulated for sustained release.

Provided herein are pharmaceutical compositions, which contain an isolated polypeptide, antibody or antigen-binding fragment thereof provided herein or a multivalent antibody provided herein, and one or more additional antiviral antibodies. In some examples, the pharmaceutical compositions contain two or more different anti-RSV antibodies or antigen-binding fragments thereof. In some examples, the pharmaceutical compositions contain two or more different anti-RSV antibodies or antigen-binding fragments selected from among an antibody or antigen-binding fragment provided herein. In some examples, the pharmaceutical compositions contain an antibody or antigen-binding fragment provided herein and an antibody selected from among palivizumab, motavizumab, AFFF, P12f2, P12f4, P11d4, A1e9, A12a6, A13c4, A17d4, A4B4, A8c7, 1X-493L1, FR H3-3F4, M3H9, Y10H6, DG AFFF(1), 6H8, L1-7E5, L2-15B10, A13a11, A1h5, A4B4(1), A4B4L1FR-S28R, A4B4-F52S, rsv6, rsv11, rsv13, rsv19, rsv21, rsv22, rsv23, RF-1, RF-2 or antigen binding fragments thereof. In some examples, the pharmaceutical compositions contain an antibody or antigen-binding fragment thereof provided herein and an antibody selected from among an antibody or antigen-binding fragment thereof that immunospecifically binds an antigen of parainfluenza virus (PIV) or human metapneumovirus (hMPV). In some examples, the PIV antigen is an antigen of human PIV type 1, human PIV type 2, human PIV type 3, and/or human PIV type 4. In some examples, the PIV antigen is selected from among a PIV nucleocapsid phosphoprotein, a PIV fusion (F) protein, a PIV phosphoprotein, a PIV large (L) protein, a PIV matrix (M) protein, a PIV hemagglutinin-neuraminidase (HN) glycoprotein, a PIV RNA-dependent RNA polymerase, a PIV Y1 protein, a PIV D protein, a PIV C protein, and allelic variants thereof. In some examples, the hMPV antigen is an antigen of hMPV type A or hMPV type B. In some examples, the hMPV antigen is an antigen of hMPV subtype A1, hMPV subtype A2, hMPV subtype B1, or hMPV subtype B2. In some examples, the hMPV antigen is selected from among a hMPV nucleoprotein, a hMPV phosphoprotein, a hMPV matrix protein, a hMPV small hydrophobic protein, a hMPV RNA-dependent RNA polymerase, a hMPV F protein, a hMPV G protein, and allelic variants thereof.

Provided herein are pharmaceutical compositions, which contain an isolated polypeptide, antibody or antigen-binding fragment thereof provided herein or a multivalent antibody provided herein, and one or more additional antiviral antibodies, where the one or more additional antiviral antibodies is a single-chain Fv (scFv), Fab, Fab', $F(ab')_2$, Fv, dsFv, diabody, Fd, or Fd' fragment.

Provided herein are pharmaceutical compositions, which contain an isolated polypeptide, antibody or antigen-binding fragment thereof provided herein or a multivalent antibody provided herein, and an antiviral agent. In some examples, the antiviral agent is ribavirin.

Provided herein are methods of treating a viral infection in a subject, which involve administering to the subject a therapeutically effective amount of a pharmaceutical composition provided herein. Provided herein are methods of treating or inhibiting one or more symptoms of a viral infection in a subject, which involve administering to the subject a therapeutically effective amount of a pharmaceutical composition provided herein. Also provided herein are methods of preventing a viral infection in a subject, which involve administering to the subject a therapeutically effective amount of a pharmaceutical composition provided herein. In a particular example, the viral infection is a RSV infection. In a particular example, the RSV infection is an upper respiratory tract infection.

Administration can be effected by any suitable route, including but not limited to, topically, parenterally, locally, or systemically, such as for example intranasally, intramuscularly, intradermally, intraperitoneally, intravenously, subcutaneously, orally, or by pulmonary administration. In some examples, a pharmaceutical composition provided herein is administered by a nebulizer or an inhaler. The pharmaceutical compositions provided herein can be administered to any suitable subject, such as a mammal, for example, a human.

In some examples, a pharmaceutical composition provided herein is administered a human infant, a human infant born prematurely or at risk of hospitalization for a RSV infection, an elderly human, a human subject which has cystic fibrosis, bronchopulmonary dysplasia, congenital heart disease, congenital immunodeficiency, acquired immunodeficiency, leukemia, or non-Hodgkin lymphoma or a human subject who has had a transplant, such as, for example, a bone marrow transplant or a liver transplant.

In some examples, a pharmaceutical composition provided herein is administered one time, two times, three times, four times or five times during RSV season (e.g., October through May). In some examples, a pharmaceutical composition provided herein is administered one time, two times, three times, four times or five times within one month, two months or three months, prior to a RSV season.

In some examples, a pharmaceutical composition provided herein can be administered with one or more antiviral agents. In some examples, the antiviral agent is ribavirin. In some examples, the pharmaceutical composition and the antiviral agent are formulated as a single composition or as separate compositions. In the methods provided herein, the pharmaceutical composition and the antiviral agent can be administered sequentially, simultaneously or intermittently.

In some examples, a pharmaceutical composition provided herein can be administered with a hormonal therapy, immunotherapy or an anti-inflammatory agent. In some examples, a pharmaceutical composition provided herein can be administered with one or more additional antiviral antibodies or antigen-binding fragments thereof The pharmaceutical composition and the one or more additional antiviral antibodies are formulated as a single composition or as separate compositions. The pharmaceutical composition and the one or more additional anti-RSV antibodies can be administered sequentially, simultaneously or intermittently. In some examples, the antigen-binding fragment is a single-chain Fv (scFv), Fab, Fab', F(ab')2, Fv, dsFv, diabody, Fd, or Fd' fragment.

In some examples, a pharmaceutical composition provided herein can be administered with one or more additional antiviral antibodies selected from among anti-RSV antibodies or antigen-binding fragments thereof, such as, for example, palivizumab, motavizumab, AFFF, P12f2, P12f4, P11d4, A1e9, A12a6, A13c4, A17d4, A4B4, A8c7, 1X-493L1, FR H3-3F4, M3H9, Y10H6, DG, AFFF(1), 6H8, L1-7E5, L2-15B10, A13a11, A1h5, A4B4(1), A4B4L1FR-S28R, A4B4-F52S, rsv6, rsv11, rsv13, rsv19, rsv21, rsv22, rsv23, RF-1, RF-2 or antigen-binding fragments thereof.

In some examples, a pharmaceutical composition provided herein can be administered with one or more additional antiviral antibodies selected from among an antibody or antigen-binding fragment thereof that immunospecifically binds an antigen of parainfluenza virus (PIV) or human metapneumovirus (hMPV). In some examples, the PIV antigen is an antigen of human PIV type 1, human PIV type 2, human PIV type 3, and/or human PIV type 4. In some examples, the PIV antigen is selected from among a PIV nucleocapsid phosphoprotein, a PIV fusion (F) protein, a PIV phosphoprotein, a PIV large (L) protein, a PIV matrix (M) protein, a PIV hemagglutinin-neuraminidase (FIN) glycoprotein, a PIV RNA-dependent RNA polymerase, a PIV Y1 protein, a PIV D protein, a PIV C protein, and allelic variants thereof. In some examples, the hMPV antigen is an antigen of hMPV type A or hMPV type B. In some examples, the hMPV antigen is an antigen of hMPV subtype A1, hMPV subtype A2, hMPV subtype B1, or hMPV subtype B2. In some examples, the hMPV antigen is selected from among a hMPV nucleoprotein, a hMPV phosphoprotein, a hMPV matrix protein, a hMPV small hydrophobic protein, a hMPV RNA-dependent RNA polymerase, a hMPV F protein, a hMPV G protein, and allelic variants thereof.

Provided herein are methods of detecting RSV infection, which involve (a) assaying the level of RSV antigen in a fluid, cell, or tissue sample using an antibody or antigen-binding fragments thereof provided herein; (b) comparing the assayed level of RSV antigen with a control level whereby an increase in the assayed level of RSV antigen compared to the control level of the RSV antigen is indicative of a RSV infection. In some examples, the cell or tissue sample is obtained from a human subject. In some examples, the cell or tissue sample is a blood, urine, saliva, lung sputum, lavage, or lymph sample.

Provided herein are isolated nucleic acids that encode the polypeptide, antibody or antigen-binding fragments thereof provided herein. Provided herein are vectors that contain a nucleic acid encoding the polypeptide, antibody or antigen-binding fragments thereof provided herein.

Provided herein are isolated cells the contain an antibody or antigen-binding fragment thereof provided herein, a nucleic acid provided herein, or a vector provided herein. The cells provided herein can be, for example, prokaryotic or eukaryotic cells. Also provided herein are transgenic animals that contain a nucleic acid provided herein or a vector provided herein. Also provided herein are methods of expressing an isolated antibody or antigen-binding fragment thereof, which involve culturing an isolated cells provided herein under conditions which express the encoded antibody or by isolation of the antibody or antigen-binding fragment from the transgenic animal provided herein. In some examples, the antibody or antigen-binding fragment is isolated from the serum or milk of the transgenic animal.

Provided herein are kits containing a polypeptide, antibody or antigen-binding fragment of provided herein, a multivalent antibody provided herein, or a combination provided herein, in one or more containers, and instructions for use.

Also provided herein are uses of an antibody or antigen-binding fragment thereof provided herein for the prevention and/or treatment of viral infection in a subject. Also provided herein are uses of an antibody or antigen-binding fragment thereof provided herein for treating or inhibiting one or more symptoms of a viral infection in a subject.

Also provided herein are uses of an antibody or antigen-binding fragment provided herein for the formulation of a medicament for the prevention and/or treatment of viral infection in a subject. Also provided herein are uses of an antibody or antigen-binding fragment provided herein for the formulation of a medicament for treating or inhibiting one or more symptoms of a viral infection in a subject.

DETAILED DESCRIPTION

Outline

A. DEFINITIONS
B. OVERVIEW
  1. Respiratory Syncytial Virus
C. ANTI-RSV ANTIBODIES
  1. General Antibody Structure and Functional Domains
  a. Structural and Functional Domains of Antibodies
  b. Antibody Fragments
  2. Exemplary Anti-RSV Antibodies
  a. Derivative Antibodies
    i. Single Chain Antibodies
    ii. Anti-idiotypic Antibodies
    iii. Multi-specific Antibodies and Antibody Multimerization
D. ADDITIONAL MODIFICATIONS OF ANTI-RSV ANTIBODIES
  1. Modifications to reduce immunogenicity
  2. Fc Modifications
  3. Pegylation
  4. Conjugation of a Detectable Moiety
  5. Conjugation of a Therapeutic Moiety
  6. Modifications to improve binding specificity
E. METHODS OF ISOLATING ANTI-RSV ANTIBODIES
F. METHODS OF PRODUCING ANTI-RSV ANTIBODIES, AND MODIFIED OR VARIANT FORMS THEREOF AND NUCLEIC ACIDS ENCODING ANTIBODIES
  1. Nucleic Acids
  2. Vectors
  3. Cell Expression Systems
  a. Prokaryotic Expression
  b. Yeast Cells
  c. Insect Cells
  d. Mammalian Cells
  e. Plants
  4. Purification of Antibodies
G. ASSESSING ANTI-RSV ANTIBODY PROPERTIES AND ACTIVITIES
  1. Binding Assays
  3. In vitro assays for analyzing virus neutralization effects of antibodies 4. In vivo animal models for assessing efficacy of the anti-RSV antibodies
5. In vitro and in vivo Assays for Measuring Antibody Efficacy H. DIAGNOSTIC USES
1. In vitro detection of pathogenic infection
2. In vivo detection of pathogenic infection
3. Monitoring Infection I. PROPHYLACTIC AND THERAPEUTIC USES
1. Subjects for therapy
2. Dosages
3. Routes of Administration
4. Combination therapies
a. Antiviral Antibodies for Combination Therapy
i. Anti-RSV antibodies
ii. Antibodies against other respiratory viruses
5. Gene Therapy J. Pharmaceutical Compositions, Combinations and Articles of manufacture/Kits
1. Pharmaceutical Compositions
2. Articles of Manufacture/Kits
3. Combinations K. Examples

A. DEFINITIONS

Unless defined otherwise, all technical and scientific terms used herein have the same meaning as is commonly understood by one of skill in the art to which the invention(s) belong. All patents, patent applications, published applications and publications, GenBank sequences, databases, websites and other published materials referred to throughout the entire disclosure herein, unless noted otherwise, are incorporated by reference in their entirety. In the event that there are a plurality of definitions for terms herein, those in this section prevail. Where reference is made to a URL or other such identifier or address, it understood that such identifiers can change and particular information on the internet can come and go, but equivalent information can be found by searching the internet. Reference thereto evidences the availability and public dissemination of such information.

As used herein, "antibody" refers to immunoglobulins and immunoglobulin fragments, whether natural or partially or wholly synthetically, such as recombinantly, produced, including any fragment thereof containing at least a portion of the variable region of the immunoglobulin molecule that retains the binding specificity ability of the full-length immunoglobulin. Hence, an antibody includes any protein having a binding domain that is homologous or substantially homologous to an immunoglobulin antigen-binding domain (antibody combining site). Antibodies include antibody fragments, such as anti-RSV antibody fragments. As used herein, the term antibody, thus, includes synthetic antibodies, recombinantly produced antibodies, multispecific antibodies (e.g., bispecific antibodies), human antibodies, non-human antibodies, humanized antibodies, chimeric antibodies, intrabodies, and antibody fragments, such as, but not limited to, Fab fragments, Fab' fragments, $F(ab')_2$ fragments, Fv fragments, disulfide-linked Fvs (dsFv), Fd fragments, Fd' fragments, single-chain Fvs (scFv), single-chain Fabs (scFab), diabodies, anti-idiotypic (anti-Id) antibodies, or antigen-binding fragments of any of the above. Antibodies provided herein include members of any immunoglobulin type (e.g., IgG, IgM, IgD, IgE, IgA and IgY), any class (e.g. IgG1, IgG2, IgG3, IgG4, IgA1 and IgA2) or subclass (e.g., IgG2a and IgG2b).

As used herein, an "antibody fragment" or "antigen-binding fragment" of an antibody refers to any portion of a full-length antibody that is less than full length but contains at least a portion of the variable region of the antibody that binds antigen (e.g. one or more CDRs and/or one or more antibody combining sites) and thus retains the binding specificity, and at least a portion of the specific binding ability of the full-length antibody; antibody fragments include antibody derivatives produced by enzymatic treatment of full-length antibodies, as well as synthetically, e.g. recombinantly produced derivatives. An antibody fragment is included among antibodies. Examples of antibody fragments include, but are not limited to, Fab, Fab', F(ab')2, single-chain Fvs (scFv), Fv, dsFv, diabody, Fd and Fd' fragments and other fragments, including modified fragments (see, for example, Methods in Molecular Biology, Vol 207: Recombinant Antibodies for Cancer Therapy Methods and Protocols (2003); Chapter 1; p 3-25, Kipriyanov). The fragment can include multiple chains linked together, such as by disulfide bridges and/or by peptide linkers. An antibody fragment generally contains at least or about 50 amino acids and typically at least or about 200 amino acids.

As used herein, an antigen-binding fragment refers to an antibody fragment that contains an antigen-binding portion that binds to the same antigen as the antibody from which the antibody fragment is derived. An antigen-binding fragment, as used herein, includes any antibody fragment that when inserted into an antibody framework (such as by replacing a corresponding region) results in an antibody that immunospecifically binds (i.e. exhibits Ka of at least or at least about $10^7$-$10^8$ $M^{-1}$) to the antigen. Antigen-binding fragments include, antibody fragments, such as Fab fragments, Fab' fragments, $F(ab')_2$ fragments, Fv fragments, disulfide-linked Fvs (dsFv), Fd fragments, Fd' fragments, single-chain Fvs (scFv), single-chain Fabs (scFab), and also includes other fragments, such as CDR-containing fragments, and polypeptides that immunospecifically bind to an antigen or that when inserted into an antibody framework results in an antibody that immunospecifically binds to the antigen.

As used herein, a "therapeutic antibody" refers to any antibody or antigen-binding fragment thereof that is administered for treatment of an animal, including a human. Such antibodies can be prepared by any known methods for the production of polypeptides, and hence, include, but are not limited to, recombinantly produced antibodies, synthetically produced antibodies, and therapeutic antibodies extracted from cells or tissues and other sources. As isolated from any sources or as produced, therapeutic antibodies can be heterogeneous in length or differ in post-translational modification, such as glycosylation (i.e. carbohydrate content). Heterogeneity of therapeutic antibodies also can differ depending on the source of the therapeutic antibodies. Hence, reference to therapeutic antibodies refers to the heterogeneous population as produced or isolated. When a homogeneous preparation is intended, it will be so-stated. References to therapeutic antibodies herein are to their monomeric, dimeric or other multimeric forms, as appropriate.

As used herein, a "neutralizing antibody" is any antibody or antigen-binding fragment thereof that binds to a pathogen and interferes with the ability of the pathogen to infect a cell and/or cause disease in a subject. Exemplary of neutralizing antibodies are neutralizing antibodies that bind to viruses, bacteria, and fungal pathogens. Typically, the neutralizing antibodies provide herein bind to the surface of the pathogen. In examples where the pathogen is a virus, a neutralizing antibody that binds to the virus typically binds to a protein on the surface of the virus. Depending on the class of the virus, the surface protein can be a capsid protein (e.g. a capsid protein of a non-enveloped virus) or a viral envelope protein (e.g., a viral envelope protein of an enveloped virus). In some examples, the protein is a glycoprotein. The ability of the virus to inhibit virus infectivity can be measure for example, by an in vitro neutralization assay, such as, for example, a plaque reduction assay using Vero host cells.

As used herein, an "enveloped virus" is an animal virus which possesses an outer membrane or envelope, which is a lipid bilayer containing viral proteins, surrounding the virus capsid. The envelope proteins of the virus participate in the assembly of the infectious particle and also are involved in virus entry by binding to receptors present on the host cell and inducing fusion between the viral envelope and a membrane of the host cell. Enveloped viruses can be either spherical or filamentous (rod-shaped). Exemplary enveloped viruses include, but are not limited to, members of the Herpesviridae, Poxviridae, Hepadnaviridae, Togaviridae, Arenaviridae, Flaviviridae, Orthomyxoviridae, Paramyxoviridae, Bunyaviridae, Rhabdoviridae, Filoviridae, Coronaviridae, and Bornaviridae virus families. Respiratory syncytial virus (RSV) is a negative sense single stranded RNA enveloped virus of the Paramyxoviridae family, Pneumovirinae subfamily.

As used herein, a "non-enveloped virus" or "naked virus" is a virus that lacks a viral envelope. For infection of a host cell, a non-enveloped virus uses proteins of the viral capsid for attachment to the target cell. Exemplary non-enveloped viruses include, but are not limited to, Adenoviridae, Papillomavirinae, Parvoviridae, Polyomavirinae, Circoviridae, Reoviridae, Picornaviridae, Caliciviridae, and Astroviridae virus families.

As used herein, a "surface protein" of a pathogen is any protein that is located on external surface of the pathogen. The surface protein can be partially or entirely exposed to the external environment (i.e. outer surface). Exemplary of surface proteins are membrane proteins, such as, for example, a protein located on the surface of a viral envelope or bacterial outer membrane (e.g., a membrane glycoprotein). Membrane proteins can be transmembrane proteins (i.e. proteins that traverse the lipid bilayer) or proteins that are non-transmembrane cell surface associated proteins (e.g., anchored or covalently attached to the surface of the membrane, such as attachment to another protein on the surface of the pathogen). Other exemplary surface proteins include viral capsid proteins of non-enveloped enveloped viruses that are at least partially exposed to the external environment.

As used herein, "monoclonal antibody" refers to a population of identical antibodies, meaning that each individual antibody molecule in a population of monoclonal antibodies is identical to the others. This property is in contrast to that of a polyclonal population of antibodies, which contains antibodies having a plurality of different sequences. Monoclonal antibodies can be produced by a number of well-known methods (Smith et al. (2004) *J. Clin. Pathol.* 57, 912-917; and Nelson et al., *J Clin Pathol* (2000), 53, 111-117). For example, monoclonal antibodies can be produced by immortalization of a B cell, for example through fusion with a myeloma cell to generate a hybridoma cell line or by infection of B cells with virus such as EBV. Recombinant technology also can be used to produce antibodies in vitro from clonal populations of host cells by transforming the host cells with plasmids carrying artificial sequences of nucleotides encoding the antibodies.

As used herein, a "conventional antibody" refers to an antibody that contains two heavy chains (which can be denoted H and H') and two light chains (which can be denoted L and L') and two antibody combining sites, where each heavy chain can be a full-length immunoglobulin heavy chain or any functional region thereof that retains antigen-binding capability (e.g. heavy chains include, but are not limited to, $V_H$, chains $V_H$-$C_H1$ chains and $V_H$-$C_H1$-$C_H2$-$C_H3$ chains), and each light chain can be a full-length light chain or any functional region of (e.g. light chains include, but are not limited to, $V_L$ chains and $V_L$-$C_L$ chains). Each heavy chain (H and H') pairs with one light chain (L and L', respectively)

As used herein, a full-length antibody is an antibody having two full-length heavy chains (e.g. $V_H$-$C_H1$-$C_H2$-$C_H3$ or $V_H$-$C_H1$-$C_H2$-$C_H3$-$C_H4$) and two full-length light chains ($V_L$-$C_L$) and hinge regions, such as human antibodies produced naturally by antibody secreting B cells and antibodies with the same domains that are synthetically produced.

As used herein, an Fv antibody fragment is composed of one variable heavy domain ($V_H$) and one variable light ($V_L$) domain linked by noncovalent interactions.

As used herein, a dsFv refers to an Fv with an engineered intermolecular disulfide bond, which stabilizes the $V_H$-$V_L$ pair.

As used herein, an Fd fragment is a fragment of an antibody containing a variable domain ($V_H$) and one constant region domain ($C_H1$) of an antibody heavy chain.

As used herein, a Fab fragment is an antibody fragment that results from digestion of a full-length immunoglobulin with papain, or a fragment having the same structure that is produced synthetically, e.g. by recombinant methods. A Fab fragment contains a light chain (containing a $V_L$ and $C_L$) and another chain containing a variable domain of a heavy chain ($V_H$) and one constant region domain of the heavy chain ($C_H1$).

As used herein, a $F(ab')_2$ fragment is an antibody fragment that results from digestion of an immunoglobulin with pepsin at pH 4.0-4.5, or a fragment having the same structure that is produced synthetically, e.g. by recombinant methods. The F(ab')2 fragment essentially contains two Fab fragments where each heavy chain portion contains an additional few amino acids, including cysteine residues that form disulfide linkages joining the two fragments.

As used herein, a Fab' fragment is a fragment containing one half (one heavy chain and one light chain) of the $F(ab')_2$ fragment.

As used herein, an Fd' fragment is a fragment of an antibody containing one heavy chain portion of a $F(ab')_2$ fragment.

As used herein, an Fv' fragment is a fragment containing only the $V_H$ and $V_L$ domains of an antibody molecule.

As used herein, hsFv refers to antibody fragments in which the constant domains normally present in a Fab fragment have been substituted with a heterodimeric coiled-coil domain (see, e.g., Arndt et al. (2001) *J Mol Biol.* 7:312:221-228).

As used herein, an scFv fragment refers to an antibody fragment that contains a variable light chain ($V_L$) and variable heavy chain ($V_H$), covalently connected by a polypeptide linker in any order. The linker is of a length such that the two variable domains are bridged without substantial interference. Exemplary linkers are $(Gly-Ser)_n$ residues with some Glu or Lys residues dispersed throughout to increase solubility.

As used herein, the term "derivative" refers to a polypeptide that contains an amino acid sequence of an anti-RSV antibody or a fragment thereof which has been modified, for example, by the introduction of amino acid residue substitutions, deletions or additions, by the covalent attachment of any type of molecule to the polypeptide (e.g., by glycosylation, acetylation, pegylation, phosphorylation, amidation, derivatization by known protecting/blocking groups, proteolytic cleavage, linkage to a cellular ligand or other protein). A derivative of an anti-RSV antibody or antigen-binding fragment thereof can be modified by chemical modifications using techniques known to those of skill in the art, including, but not limited to, specific chemical cleavage, acetylation, formylation, metabolic synthesis of tunicamycin. Further, a derivative of an anti-RSV antibody or antigen-binding fragment thereof can contain one or more non-classical amino acids. Typically, a polypeptide derivative possesses a similar or identical function as an anti-RSV antibody or antigen-binding fragment thereof provided herein (e.g. neutralization of RSV).

As used herein, the phrase "derived from" when referring to antibody fragments derived from another antibody, such as a monoclonal antibody, refers to the engineering of antibody fragments (e.g., Fab, F(ab'), F(ab')$_2$, single-chain Fvs (scFv), Fv, dsFv, diabody, Fd and Fd' fragments) that retain the binding specificity of the original antibody. Such fragments can be derived by a variety of methods known in the art, including, but not limited to, enzymatic cleavage, chemical crosslinking, recombinant means or combinations thereof. Generally, the derived antibody fragment shares the identical or substantially identical heavy chain variable region ($V_H$) and light chain variable region ($V_L$) of the parent antibody, such that the antibody fragment and the parent antibody bind the same epitope.

As used herein, a "parent antibody" or "source antibody" refers the to an antibody from which an antibody fragment (e.g., Fab, F(ab'), F(ab')$_2$, single-chain Fvs (scFv), Fv, dsFv, diabody, Fd and Fd' fragments) is derived.

As used herein, the term "epitope" refers to any antigenic determinant on an antigen to which the paratope of an antibody binds. Epitopic determinants typically contain chemically active surface groupings of molecules such as amino acids or sugar side chains and typically have specific three dimensional structural characteristics, as well as specific charge characteristics.

As used herein, a chimeric polypeptide refers to a polypeptide that contains portions from at least two different polypeptides or from two non-contiguous portions of a single polypeptide. Thus, a chimeric polypeptide generally includes a sequence of amino acid residues from all or part of one polypeptide and a sequence of amino acids from all or part of another different polypeptide. The two portions can be linked directly or indirectly and can be linked via peptide bonds, other covalent bonds or other non-covalent interactions of sufficient strength to maintain the integrity of a substantial portion of the chimeric polypeptide under equilibrium conditions and physiologic conditions, such as in isotonic pH 7 buffered saline. For purposes herein, chimeric polypeptides include those containing all or part of an anti-RSV antibody linked to another polypeptide, such as, for example, a multimerization domain, a heterologous immunoglobulin constant domain or framework region, or a diagnostic or therapeutic polypeptide.

As used herein, a fusion protein is a polypeptide engineered to contain sequences of amino acids corresponding to two distinct polypeptides, which are joined together, such as by expressing the fusion protein from a vector containing two nucleic acids, encoding the two polypeptides, in close proximity, e.g. adjacent, to one another along the length of the vector. Generally, a fusion protein provided herein refers to a polypeptide that contains a polypeptide having the amino acid sequence of an antibody or antigen-binding fragment thereof and a polypeptide or peptide having the amino acid sequence of a heterologous polypeptide or peptide, such as, for example, a diagnostic or therapeutic polypeptide. Accordingly, a fusion protein refers to a chimeric protein containing two or portions from two or more proteins or peptides that are linked directly or indirectly via peptide bonds. The two molecules can be adjacent in the construct or separated by a linker, or spacer polypeptide. The spacer can encode a polypeptide that alters the properties of the polypeptide, such as solubility or intracellular trafficking.

As used herein, "linker" or "spacer" peptide refers to short sequences of amino acids that join two polypeptide sequences (or nucleic acid encoding such an amino acid sequence). "Peptide linker" refers to the short sequence of amino acids joining the two polypeptide sequences. Exemplary of polypeptide linkers are linkers joining a peptide transduction domain to an antibody or linkers joining two antibody chains in a synthetic antibody fragment such as an scFv fragment. Linkers are well-known and any known linkers can be used in the provided methods. Exemplary of polypeptide linkers are (Gly-Ser)$_n$ amino acid sequences, with some Glu or Lys residues dispersed throughout to increase solubility. Other exemplary linkers are described herein; any of these and other known linkers can be used with the provided compositions and methods.

As used herein, "antibody hinge region" or "hinge region" refers to a polypeptide region that exists naturally in the heavy chain of the gamma, delta, and alpha antibody isotypes, between the $C_H1$ and $C_H2$ domains that has no homology with the other antibody domains. This region is rich in proline residues and gives the IgG, IgD and IgA antibodies flexibility, allowing the two "arms" (each containing one antibody combining site) of the Fab portion to be mobile, assuming various angles with respect to one another as they bind antigen. This flexibility allows the Fab arms to move in order to align the antibody combining sites to interact with epitopes on cell surfaces or other antigens. Two interchain disulfide bonds within the hinge region stabilize the interaction between the two heavy chains. In some embodiments provided herein, the synthetically produced antibody fragments contain one or more hinge region, for example, to promote stability via interactions between two antibody chains. Hinge regions are exemplary of dimerization domains.

As used herein, diabodies are dimeric scFv; diabodies typically have shorter peptide linkers than scFvs, and preferentially dimerize.

As used herein, humanized antibodies refer to antibodies that are modified to include "human" sequences of amino acids so that administration to a human does not provoke an immune response. A humanized antibody typically contains complementarily determining regions (CDRs) derived from a non-human species immunoglobulin and the remainder of the antibody molecule derived mainly from a human immunoglobulin. Methods for preparation of such antibodies are known. For example, DNA encoding a monoclonal antibody can be altered by recombinant DNA techniques to encode an antibody in which the amino acid composition of the non-variable regions is based on human antibodies. Methods for identifying such regions are known, including computer programs, which are designed for identifying the variable and non-variable regions of immunoglobulins.

As used herein, idiotype refers to a set of one or more antigenic determinants specific to the variable region of an immunoglobulin molecule.

As used herein, anti-idiotype antibody refers to an antibody directed against the antigen-specific part of the sequence of an antibody or T cell receptor. In principle an anti-idiotype antibody inhibits a specific immune response.

As used herein, an Ig domain is a domain, recognized as such by those in the art, that is distinguished by a structure, called the Immunoglobulin (Ig) fold, which contains two beta-pleated sheets, each containing anti-parallel beta strands of amino acids connected by loops. The two beta sheets in the Ig fold are sandwiched together by hydrophobic interactions and a conserved intra-chain disulfide bond. Individual immunoglobulin domains within an antibody chain further can be distinguished based on function. For example, a light chain contains one variable region domain ($V_L$) and one constant region domain ($C_L$), while a heavy chain contains one variable region domain ($V_H$) and three or four constant region domains ($C_H$). Each $V_L$, $C_L$, $V_H$, and $C_H$ domain is an example of an immunoglobulin domain.

As used herein, a variable domain or variable region is a specific Ig domain of an antibody heavy or light chain that contains a sequence of amino acids that varies among different antibodies. Each light chain and each heavy chain has one variable region domain, $V_L$ and $V_H$, respectively. The variable domains provide antigen specificity, and thus are responsible for antigen recognition. Each variable region contains CDRs that are part of the antigen-binding site domain and framework regions (FRs).

As used herein, "antigen-binding domain," "antigen-binding site," "antigen combining site" and "antibody combining site" are used synonymously to refer to a domain within an antibody that recognizes and physically interacts with cognate antigen. A native conventional full-length antibody molecule has two conventional antigen-binding sites, each containing portions of a heavy chain variable region and portions of a light chain variable region. A conventional antigen-binding site contains the loops that connect the anti-parallel beta strands within the variable region domains. The antigen combining sites can contain other portions of the variable region domains. Each conventional antigen-binding site contains three hypervariable regions from the heavy chain and three hypervariable regions from the light chain. The hypervariable regions also are called complementarity-determining regions (CDRs).

As used herein, "hypervariable region," "HV," "complementarity-determining region" and "CDR" and "antibody CDR" are used interchangeably to refer to one of a plurality of portions within each variable region that together form an antigen-binding site of an antibody. Each variable region domain contains three CDRs, named CDR1, CDR2 and CDR3. The three CDRs are non-contiguous along the linear amino acid sequence, but are proximate in the folded polypeptide. The CDRs are located within the loops that join the parallel strands of the beta sheets of the variable domain. As described herein, one of skill in the art knows and can identify the CDRs based on Kabat or Chothia numbering (see e.g., Kabat, E. A. et al. (1991) *Sequences of Proteins of Immunological Interest*, Fifth Edition, U.S. Department of Health and Human Services, NIH Publication No. 91-3242, and Chothia, C. et al. (1987) *J. Mol. Biol.* 196:901-917).

As used herein, framework regions (FRs) are the domains within the antibody variable region domains that are located within the beta sheets; the FR regions are comparatively more conserved, in terms of their amino acid sequences, than the hypervariable regions.

As used herein, a "constant region" domain is a domain in an antibody heavy or light chain that contains a sequence of amino acids that is comparatively more conserved than that of the variable region domain. In conventional full-length antibody molecules, each light chain has a single light chain constant region ($C_L$) domain and each heavy chain contains one or more heavy chain constant region ($C_H$) domains, which include, $C_H1$, $C_H2$, $C_H3$ and $C_H4$. Full-length IgA, IgD and IgG isotypes contain $C_H1$, $C_H2$ $C_H3$ and a hinge region, while IgE and IgM contain $C_H1$, $C_H2$ $C_H3$ and $C_H4$. $C_H1$ and $C_L$ domains extend the Fab arm of the antibody molecule, thus contributing to the interaction with antigen and rotation of the antibody arms. Antibody constant regions can serve effector functions, such as, but not limited to, clearance of antigens, pathogens and toxins to which the antibody specifically binds, e.g., through interactions with various cells, biomolecules and tissues.

As used herein, a functional region of an antibody is a portion of the antibody that contains at least a $V_H$, $V_L$, $C_H$ (e.g. $C_H1$, $C_H2$ or $C_H3$), $C_L$ or hinge region domain of the antibody, or at least a functional region thereof.

As used herein, a functional region of a $V_H$ domain is at least a portion of the full $V_H$ domain that retains at least a portion of the binding specificity of the full $V_H$ domain (e.g. by retaining one or more CDR of the full $V_H$ domain), such that the functional region of the $V_H$ domain, either alone or in combination with another antibody domain (e.g. $V_L$ domain) or region thereof, binds to antigen. Exemplary functional regions of $V_H$ domains are regions containing the CDR1, CDR2 and/or CDR3 of the $V_H$ domain.

As used herein, a functional region of a $V_L$ domain is at least a portion of the full $V_L$ domain that retains at least a portion of the binding specificity of the full $V_L$ domain (e.g. by retaining one or more CDRs of the full $V_L$ domain), such that the function region of the $V_L$ domain, either alone or in combination with another antibody domain (e.g. $V_H$ domain) or region thereof, binds to antigen. Exemplary functional regions of $V_L$ domains are regions containing the CDR1, CDR2 and/or CDR3 of the $V_L$ domain.

As used herein, "specifically bind" or "immunospecifically bind" with respect to an antibody or antigen-binding fragment thereof are used interchangeably herein and refer to the ability of the antibody or antigen-binding fragment to form one or more noncovalent bonds with a cognate antigen, by noncovalent interactions between the antibody combining site(s) of the antibody and the antigen. The antigen can be an isolated antigen or presented in a virus. Typically, an antibody that immunospecifically binds (or that specifically binds) to a virus antigen or virus is one that binds to the virus antigen (or to the antigen in the virus or to the virus) with an affinity constant Ka of about or $1\times10^7$ $M^{-1}$ or $1\times10^8$ $M^{-1}$ or greater (or a dissociation constant ($K_d$) of $1\times10^{-7}$M or $1\times10^{-8}$ M or less). Affinity constants can be determined by standard kinetic methodology for antibody reactions, for example, immunoassays, surface plasmon resonance (SPR) (Rich and Myszka (2000) *Curr. Opin. Biotechnol* 11:54; Englebienne (1998) *Analyst.* 123:1599), isothermal titration calorimetry (ITC) or other kinetic interaction assays known in the art (see, e.g., Paul, ed., Fundamental Immunology, 2nd ed., Raven Press, New York, pages 332-336 (1989); see also U.S. Pat. No. 7,229,619 for a description of exemplary SPR and ITC methods for calculating the binding affinity of anti-RSV antibodies). Instrumentation and methods for real time detection and monitoring of binding rates are known and are commercially available (e.g., BiaCore 2000, Biacore AB, Upsala, Sweden and GE Healthcare Life Sciences; Malmqvist (2000) *Biochem. Soc. Trans.* 27:335). An antibody that immunospecifically binds to a virus antigen (or virus) can bind to other peptides, polypeptides, or proteins or viruses with equal or lower binding affinity. Typically, an antibody or antigen-binding fragment thereof provided herein that binds immunospecifically to a RSV F protein (or RSV virus) does not cross-react with other antigens or cross reacts with substantially (at least 10-100 fold) lower affinity for such antigens. Antibodies or antigen-binding fragments that immunospecifically bind to a particular virus antigen (e.g. a RSV F protein) can be identified, for example, by immunoassays, such as radioimmunoassays (RIA), enzyme-linked immunosorbent assays (ELISAs), surface plasmon resonance, or other techniques known to those of skill in the art. An antibody or antigen-binding fragment thereof that immunospecifically binds to an epitope on a RSV F protein typically is one that binds to the epitope (presented in the protein or virus) with a higher binding affinity than to any cross-reactive epitope as determined using experimental techniques, such as, but not limited to, immunoassays, surface plasmon resonance, or other techniques known to those of skill in the art. Immunospecific binding to an isolated RSV protein (i.e., a recombinantly produced protein), such as RSV F protein, does not necessarily mean that the antibody will exhibit the same immunospecific binding and/or neutralization of the virus. Such measurements and properties are distinct. The affinity for the antibody or antigen-binding fragments for virus or the antigen as presented in the virus can be determined. For purposes herein, when describing an affinity or related term, the target, such as the isolated protein or the virus, will be identified.

As used herein, the term "surface plasmon resonance" refers to an optical phenomenon that allows for the analysis of real-time interactions by detection of alterations in protein concentrations within a biosensor matrix, for example, using the BiaCore system (GE Healthcare Life Sciences).

As used herein, a "multivalent" antibody is an antibody containing two or more antigen-binding sites. Multivalent antibodies encompass bivalent, trivalent, tetravalent, pentavalent, hexavalent, heptavalent or higher valency antibodies.

As used herein, a "monospecific" is an antibody that contains two or more antigen-binding sites, where each antigen-binding site immunospecifically binds to the same epitope.

As used herein, a "multispecific" antibody is an antibody that contains two or more antigen-binding sites, where at least two of the antigen-binding sites immunospecifically bind to different epitopes.

As used herein, a "bispecific" antibody is a multispecific antibody that contains two or more antigen-binding sites and can immunospecifically bind to two different epitopes. A "trispecific" antibody is a multispecific antibody that contains three or more antigen-binding sites and can immunospecifically bind to three different epitopes, a "tetraspecific" antibody is a multispecific antibody that contains four or more antigen-binding sites and can immunospecifically bind to four different epitopes, and so on.

As used herein, a "heterobivalent" antibody is a bispecific antibody that contains two antigen-binding sites, where each antigen-binding site immunospecifically binds to a different epitope.

As used herein, a "homobivalent" antibody is a monospecific antibody that contains two antigen-binding sites, where each antigen-binding site immunospecifically binds to the same epitope. Homobivalent antibodies include, but are not limited to, conventional full length antibodies, engineered or synthetic full-length antibodies, any multimer of two identical antigen-binding fragments, or any multimer two antigen-binding fragments containing the same antigen-binding domain.

As used herein, a multimerization domain refers to a sequence of amino acids that promotes stable interaction of a polypeptide molecule with one or more additional polypeptide molecules, each containing a complementary multimerization domain, which can be the same or a different multimerization domain to form a stable multimer with the first domain. Generally, a polypeptide is joined directly or indirectly to the multimerization domain. Exemplary multimerization domains include the immunoglobulin sequences or portions thereof, leucine zippers, hydrophobic regions, hydrophilic regions, and compatible protein-protein interaction domains. The multimerization domain, for example, can be an immunoglobulin constant region or domain, such as, for example, the Fc domain or portions thereof from IgG, including IgG1, IgG2, IgG3 or IgG4 subtypes, IgA, IgE, IgD and IgM and modified forms thereof.

As used herein, dimerization domains are multimerization domains that facilitate interaction between two polypeptide sequences (such as, but not limited to, antibody chains). Dimerization domains include, but are not limited to, an amino acid sequence containing a cysteine residue that facilitates formation of a disulfide bond between two polypeptide sequences, such as all or part of a full-length antibody hinge region, or one or more dimerization sequences, which are sequences of amino acids known to promote interaction between polypeptides (e.g., leucine zippers, GCN4 zippers).

As used herein, "Fc" or "Fc region" or "Fc domain" refers to a polypeptide containing the constant region of an antibody heavy chain, excluding the first constant region immunoglobulin domain. Thus, Fc refers to the last two constant region immunoglobulin domains of IgA, IgD, and IgE, or the last three constant region immunoglobulin domains of IgE and IgM. Optionally, an Fc domain can include all or part of the flexible hinge N-terminal to these domains. For IgA and IgM, Fc can include the J chain. For an exemplary Fc domain of IgG, Fc contains immunoglobulin domains Cγ2 and Cγ3, and optionally, all or part of the hinge between Cγ1 and Cγ2. The boundaries of the Fc region can vary, but typically, include at least part of the hinge region. In addition, Fc also includes any allelic or species variant or any variant or modified form, such as any variant or modified form that alters the binding to an FcR or alters an Fc-mediated effector function.

As used herein, "Fc chimera" refers to a chimeric polypeptide in which one or more polypeptides is linked, directly or indirectly, to an Fc region or a derivative thereof. Typically, an Fc chimera combines the Fc region of an immunoglobulin with another polypeptide, such as for example an anti-RSV antibody fragment. Derivatives of or modified Fc polypeptides are known to those of skill in the art.

As used herein, a "protein transduction domain" or "PTD" is a peptide domain that can be conjugated to a protein, such as an antibody provided herein, to promote the attachment to and/or uptake of the protein into a target cell.

As used herein, a "tag" or an "epitope tag" refers to a sequence of amino acids, typically added to the N- or C-terminus of a polypeptide, such as an antibody provided herein. The inclusion of tags fused to a polypeptide can facilitate polypeptide purification and/or detection. Typically, a tag or tag polypeptide refers to polypeptide that has enough residues to provide an epitope recognized by an antibody or can serve for detection or purification, yet is short enough such that it does not interfere with activity of chimeric polypeptide to which it is linked. The tag polypeptide typically is sufficiently unique so an antibody that specifically binds thereto does not substantially cross-react with epitopes in the polypeptide to which it is linked. Suitable tag polypeptides generally have at least 5 or 6 amino acid residues and usually between about 8-50 amino acid residues, typically between 9-30 residues. The tags can be linked to one or more chimeric polypeptides in a multimer and permit detection of the multimer or its recovery from a sample or mixture. Such tags are well known and can be readily synthesized and designed. Exemplary tag polypeptides include those used for affinity purification and include, His tags, the influenza hemagglutinin (HA) tag polypeptide and its antibody 12CA5, (Field et al. (1988) *Mol.*

*Cell. Biol.* 8:2159-2165); the c-myc tag and the 8F9, 3C7, 6E10, G4, B7 and 9E10 antibodies thereto (see, e.g., Evan et al. (1985) *Molecular and Cellular Biology* 5:3610-3616); and the Herpes Simplex virus glycoprotein D (gD) tag and its antibody (Paborsky et al. (1990) *Protein Engineering* 3:547-553 (1990). An antibody used to detect an epitope-tagged antibody is typically referred to herein as a secondary antibody.

As used herein, "polypeptide" refers to two or more amino acids covalently joined. The terms "polypeptide" and "protein" are used interchangeably herein.

As used herein, a "peptide" refers to a polypeptide that is from 2 to about or 40 amino acids in length.

As used herein, an "amino acid" is an organic compound containing an amino group and a carboxylic acid group. A polypeptide contains two or more amino acids. For purposes herein, amino acids contained in the antibodies provided include the twenty naturally-occurring amino acids (Table 1), non-natural amino acids, and amino acid analogs (e.g., amino acids wherein the α-carbon has a side chain). As used herein, the amino acids, which occur in the various amino acid sequences of polypeptides appearing herein, are identified according to their well-known, three-letter or one-letter abbreviations (see Table 1). The nucleotides, which occur in the various nucleic acid molecules and fragments, are designated with the standard single-letter designations used routinely in the art.

As used herein, "amino acid residue" refers to an amino acid formed upon chemical digestion (hydrolysis) of a polypeptide at its peptide linkages. The amino acid residues described herein are generally in the "L" isomeric form. Residues in the "D" isomeric form can be substituted for any L-amino acid residue, as long as the desired functional property is retained by the polypeptide. $NH_2$ refers to the free amino group present at the amino terminus of a polypeptide. COOH refers to the free carboxy group present at the carboxyl terminus of a polypeptide. In keeping with standard polypeptide nomenclature described in *J. Biol. Chem.,* 243: 3557-59 (1968) and adopted at 37 C.F.R. §§. 1.821-1.822, abbreviations for amino acid residues are shown in Table 1:

TABLE 1

Table of Correspondence

| SYMBOL | | |
|---|---|---|
| 1-Letter | 3-Letter | AMINO ACID |
| Y | Tyr | Tyrosine |
| G | Gly | Glycine |
| F | Phe | Phenylalanine |
| M | Met | Methionine |
| A | Ala | Alanine |
| S | Ser | Serine |
| I | Ile | Isoleucine |
| L | Leu | Leucine |
| T | Thr | Threonine |
| V | Val | Valine |
| P | Pro | Proline |
| K | Lys | Lysine |
| H | His | Histidine |
| Q | Gln | Glutamine |
| E | Glu | Glutamic acid |
| Z | Glx | Glutamic Acid and/or Glutamine |
| W | Trp | Tryptophan |
| R | Arg | Arginine |
| D | Asp | Aspartic acid |
| N | Asn | Asparagine |
| B | Asx | Aspartic Acid and/or Asparagine |
| C | Cys | Cysteine |
| X | Xaa | Unknown or other |

All sequences of amino acid residues represented herein by a formula have a left to right orientation in the conventional direction of amino-terminus to carboxyl-terminus. In addition, the phrase "amino acid residue" is defined to include the amino acids listed in the Table of Correspondence (Table 1), modified, non-natural and unusual amino acids. Furthermore, a dash at the beginning or end of an amino acid residue sequence indicates a peptide bond to a further sequence of one or more amino acid residues or to an amino-terminal group such as $NH_2$ or to a carboxyl-terminal group such as COOH.

In a peptide or protein, suitable conservative substitutions of amino acids are known to those of skill in this art and generally can be made without altering a biological activity of a resulting molecule. Those of skill in this art recognize that, in general, single amino acid substitutions in non-essential regions of a polypeptide do not substantially alter biological activity (see, e.g., Watson et al., *Molecular Biology of the Gene,* 4th Edition, 1987, The Benjamin/Cummings Pub. co., p. 224).

Such substitutions can be made in accordance with those set forth in Table 2 as follows:

TABLE 2

| Original residue | Conservative substitution |
|---|---|
| Ala (A) | Gly; Ser |
| Arg (R) | Lys |
| Asn (N) | Gln; His |
| Cys (C) | Ser |
| Gln (Q) | Asn |
| Glu (E) | Asp |
| Gly (G) | Ala; Pro |
| His (H) | Asn; Gln |
| Ile (I) | Leu; Val |
| Leu (L) | Ile; Val |
| Lys (K) | Arg; Gln; Glu |
| Met (M) | Leu; Tyr; Ile |
| Phe (F) | Met; Leu; Tyr |
| Ser (S) | Thr |
| Thr (T) | Ser |
| Trp (W) | Tyr |
| Tyr (Y) | Trp; Phe |
| Val (V) | Ile; Leu |

Other substitutions also are permissible and can be determined empirically or in accord with other known conservative or non-conservative substitutions.

As used herein, "naturally occurring amino acids" refer to the 20 L-amino acids that occur in polypeptides.

As used herein, the term "non-natural amino acid" refers to an organic compound that has a structure similar to a natural amino acid but has been modified structurally to mimic the structure and reactivity of a natural amino acid. Non-naturally occurring amino acids thus include, for example, amino acids or analogs of amino acids other than the 20 naturally occurring amino acids and include, but are not limited to, the D-isostereomers of amino acids. Exemplary non-natural amino acids are known to those of skill in the art, and include, but are not limited to, 2-Aminoadipic acid (Aad), 3-Aminoadipic acid (Baad), β-alanine/β-Amino-propionic acid (Bala), 2-Aminobutyric acid (Abu), 4-Aminobutyric acid/piperidinic acid (4Abu), 6-Aminocaproic acid (Acp), 2-Aminoheptanoic acid (Ahe), 2-Aminoisobutyric acid (Aib), 3-Aminoisobutyric acid (Baib), 2-Aminopimelic acid (Apm), 2,4-Diaminobutyric acid (Dbu), Desmosine (Des), 2,2'-Diaminopimelic acid (Dpm), 2,3-Diaminopropionic acid (Dpr), N-Ethylglycine (EtGly), N-Ethylasparagine (EtAsn), Hydroxylysine (Hyl), allo-Hydroxylysine (Ahyl), 3-Hydroxyproline (3Hyp), 4-Hydroxyproline (4Hyp), Isodesmosine (Ide), allo-Isoleucine (Aile), N-Methylglycine, sarcosine (MeGly), N-Methylisoleucine (MeIle), 6-N-Methyllysine (MeLys), N-Methylvaline (MeVal), Norvaline (Nva), Norleucine (Nle) and Ornithine (Orn).

As used herein, a "native polypeptide" or a "native nucleic acid" molecule is a polypeptide or nucleic acid molecule, respectively, that can be found in nature. A native polypeptide or nucleic acid molecule can be the wild-type form of a polypeptide or nucleic acid molecule. A native polypeptide or nucleic acid molecule can be the predominant form of the polypeptide, or any allelic or other natural variant thereof. The variant polypeptides and nucleic acid molecules provided herein can have modifications compared to native polypeptides and nucleic acid molecules.

As used herein, the wild-type form of a polypeptide or nucleic acid molecule is a form encoded by a gene or by a coding sequence encoded by the gene. Typically, a wild-type form of a gene, or molecule encoded thereby, does not contain mutations or other modifications that alter function or structure. The term wild-type also encompasses forms with allelic variation as occurs among and between species. As used herein, a predominant form of a polypeptide or nucleic acid molecule refers to a form of the molecule that is the major form produced from a gene. A "predominant form" varies from source to source. For example, different cells or tissue types can produce different forms of polypeptides, for example, by alternative splicing and/or by alternative protein processing. In each cell or tissue type, a different polypeptide can be a "predominant form."

As used herein, an "allelic variant" or "allelic variation" references any of two or more alternative forms of a gene occupying the same chromosomal locus. Allelic variation arises naturally through mutation, and can result in phenotypic polymorphism within populations. Gene mutations can be silent (no change in the encoded polypeptide) or can encode polypeptides having altered amino acid sequence. The term "allelic variant" also is used herein to denote a protein encoded by an allelic variant of a gene. Typically the reference form of the gene encodes a wild type form and/or predominant form of a polypeptide from a population or single reference member of a species. Typically, allelic variants, which include variants between and among species typically have at least or about 80%, 85%, 90%, 95% or greater amino acid identity with a wild type and/or predominant form from the same species; the degree of identity depends upon the gene and whether comparison is interspecies or intraspecies. Generally, intraspecies allelic variants have at least or about 80%, 85%, 90% or 95% identity or greater with a wild type and/or predominant form, including 96%, 97%, 98%, 99% or greater identity with a wild type and/or predominant form of a polypeptide. Reference to an allelic variant herein generally refers to variations n proteins among members of the same species.

As used herein, "allele," which is used interchangeably herein with "allelic variant" refers to alternative forms of a gene or portions thereof. Alleles occupy the same locus or position on homologous chromosomes. When a subject has two identical alleles of a gene, the subject is said to be homozygous for that gene or allele. When a subject has two different alleles of a gene, the subject is said to be heterozygous for the gene. Alleles of a specific gene can differ from each other in a single nucleotide or several nucleotides, and can include substitutions, deletions and insertions of nucleotides. An allele of a gene also can be a form of a gene containing a mutation.

As used herein, "species variants" refer to variants in polypeptides among different species, including different mammalian species, such as mouse and human, and species of microorganisms, such as viruses and bacteria.

As used herein, a polypeptide "domain" is a part of a polypeptide (a sequence of three or more, generally 5, 10 or more amino acids) that is a structurally and/or functionally distinguishable or definable. Exemplary of a polypeptide domain is a part of the polypeptide that can form an independently folded structure within a polypeptide made up of one or more structural motifs (e.g. combinations of alpha helices and/or beta strands connected by loop regions) and/or that is recognized by a particular functional activity, such as enzymatic activity, dimerization or antigen-binding. A polypeptide can have one or more, typically more than one, distinct domains. For example, the polypeptide can have one or more structural domains and one or more functional domains. A single polypeptide domain can be distinguished based on structure and function. A domain can encompass a contiguous linear sequence of amino acids. Alternatively, a domain can encompass a plurality of non-contiguous amino acid portions, which are non-contiguous along the linear sequence of amino acids of the polypeptide. Typically, a polypeptide contains a plurality of domains. For example, each heavy chain and each light chain of an antibody molecule contains a plurality of immunoglobulin (Ig) domains, each about 110 amino acids in length.

Those of skill in the art are familiar with polypeptide domains and can identify them by virtue of structural and/or functional homology with other such domains. For exemplification herein, definitions are provided, but it is understood that it is well within the skill in the art to recognize particular domains by name. If needed, appropriate software can be employed to identify domains.

As used herein, a functional region of a polypeptide is a region of the polypeptide that contains at least one functional domain (which imparts a particular function, such as an ability to interact with a biomolecule, for example, through antigen-binding, DNA binding, ligand binding, or dimerization, or by enzymatic activity, for example, kinase activity or proteolytic activity); exemplary of functional regions of polypeptides are antibody domains, such as $V_H$, $V_L$, $C_H$, $C_L$, and portions thereof, such as CDRs, including CDR1, CDR2 and CDR3, or antigen-binding portions, such as antibody combining sites.

As used herein, a structural region of a polypeptide is a region of the polypeptide that contains at least one structural domain.

As used herein, a region of a polynucleotide is a portion of the polynucleotide containing two or more, typically at least six or more, typically ten or more, contiguous nucleotides, for example, 2, 3, 4, 5, 6, 8, 10, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more nucleotides of the polynucleotide, but not necessarily all the nucleotides that make up the polynucleotide.

As used herein, a "property" of a polypeptide, such as an antibody, refers to any property exhibited by a polypeptide, including, but not limited to, binding specificity, structural configuration or conformation, protein stability, resistance to proteolysis, conformational stability, thermal tolerance, and tolerance to pH conditions. Changes in properties can alter an "activity" of the polypeptide. For example, a change in the binding specificity of the antibody polypeptide can alter the ability to bind an antigen, and/or various binding activities, such as affinity or avidity, or in vivo activities of the polypeptide.

As used herein, an "activity" or a "functional activity" of a polypeptide, such as an antibody, refers to any activity exhibited by the polypeptide. Such activities can be empirically determined. Exemplary activities include, but are not limited to, ability to interact with a biomolecule, for example, through antigen-binding, DNA binding, ligand binding, or dimerization, enzymatic activity, for example, kinase activity or proteolytic activity. For an antibody (including antibody fragments), activities include, but are not limited to, the ability to specifically bind a particular antigen, affinity of antigen-binding (e.g. high or low affinity), avidity of antigen-binding (e.g. high or low avidity), on-rate, off-rate, effector functions, such as the ability to promote antigen neutralization or clearance, virus neutralization, and in vivo activities, such as the ability to prevent infection or invasion of a pathogen, or to promote clearance, or to penetrate a particular tissue or fluid or cell in the body. Activity can be assessed in vitro or in vivo using recognized assays, such as ELISA, flow cytometry, surface plasmon resonance or equivalent assays to measure on- or off-rate, immunohistochemistry and immunofluorescence histology and microscopy, cell-based assays, flow cytometry and binding assays (e.g., panning assays). For example, for an antibody polypeptide, activities can be assessed by measuring binding affinities, avidities, and/or binding coefficients (e.g., for on-/off-rates), and other activities in vitro or by measuring various effects in vivo, such as immune effects, e.g. antigen clearance, penetration or localization of the antibody into tissues, protection from disease, e.g. infection, serum or other fluid antibody titers, or other assays that are well known in the art. The results of such assays that indicate that a polypeptide exhibits an activity can be correlated to activity of the polypeptide in vivo, in which in vivo activity can be referred to as therapeutic activity, or biological activity. Activity of a modified polypeptide can be any level of percentage of activity of the unmodified polypeptide, including but not limited to, 1% of the activity, 2%, 3%, 4%, 5%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500%, or more of activity compared to the unmodified polypeptide. Assays to determine functionality or activity of modified (e.g. variant) antibodies are well known in the art.

As used herein. "therapeutic activity" refers to the in vivo activity of a therapeutic polypeptide. Generally, the therapeutic activity is the activity that is used to treat a disease or condition. Therapeutic activity of a modified polypeptide can be any level of percentage of therapeutic activity of the unmodified polypeptide, including but not limited to, 1% of the activity, 2%, 3%, 4%, 5%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500%, or more of therapeutic activity compared to the unmodified polypeptide.

As used herein, "exhibits at least one activity" or "retains at least one activity" refers to the activity exhibited by a modified polypeptide, such as a variant polypeptide produced according to the provided methods, such as a modified, e.g. variant antibody or other therapeutic polypeptide (e.g. a modified anti-RSV antibody or antigen-binding fragment thereof), compared to the target or unmodified polypeptide, that does not contain the modification. A modified, or variant, polypeptide that retains an activity of a target polypeptide can exhibit improved activity or maintain the activity of the unmodified polypeptide. In some instances, a modified, or variant, polypeptide can retain an activity that is increased compared to an target or unmodified polypeptide. In some cases, a modified, or variant, polypeptide can retain an activity that is decreased compared to an unmodified or target polypeptide. Activity of a modified, or variant, polypeptide can be any level of percentage of activity of the unmodified or target polypeptide, including but not limited to, 1% of the activity, 2%, 3%, 4%, 5%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500%, or more activity compared to the unmodified or target polypeptide. In other embodiments, the change in activity is at least about 2 times, 3 times, 4 times, 5 times, 6 times, 7 times, 8 times, 9 times, 10 times, 20 times, 30 times, 40 times, 50 times, 60 times, 70 times, 80 times, 90 times, 100 times, 200 times, 300 times, 400 times, 500 times, 600 times, 700 times, 800 times, 900 times, 1000 times, or more times greater than unmodified or target polypeptide. Assays for retention of an activity depend on the activity to be retained. Such assays can be performed in vitro or in vivo. Activity can be measured, for example, using assays known in the art and described in the Examples below for activities such as but not limited to ELISA and panning assays. Activities of a modified, or variant, polypeptide compared to an unmodified or target polypeptide also can be assessed in terms of an in vivo therapeutic or biological activity or result following administration of the polypeptide.

As used herein, the term "assessing" is intended to include quantitative and qualitative determination in the sense of obtaining an absolute value for the activity of a protease, or a domain thereof, present in the sample, and also of obtaining an index, ratio, percentage, visual, or other value indicative of the level of the activity. Assessment can be direct or indirect and the chemical species actually detected need not of course be the proteolysis product itself but can for example be a derivative thereof or some further substance. For example, detection of a cleavage product of a complement protein, such as by SDS-PAGE and protein staining with Coomassie blue.

As used herein, the term "nucleic acid" refers to at least two linked nucleotides or nucleotide derivatives, including a deoxyribonucleic acid (DNA) and a ribonucleic acid (RNA), joined together, typically by phosphodiester linkages. Also included in the term "nucleic acid" are analogs of nucleic acids such as peptide nucleic acid (PNA), phosphorothioate DNA, and other such analogs and derivatives or combinations thereof. Nucleic acids also include DNA and RNA derivatives containing, for example, a nucleotide analog or a "backbone" bond other than a phosphodiester bond, for example, a phosphotriester bond, a phosphoramidate bond, a phosphorothioate bond, a thioester bond, or a peptide bond (peptide nucleic acid). The term also includes, as equivalents, derivatives, variants and analogs of either RNA or DNA made from nucleotide analogs, single (sense or antisense) and double-stranded nucleic acids. Deoxyribonucleotides include deoxyadenosine, deoxycytidine, deoxyguanosine and deoxythymidine. For RNA, the uracil base is uridine.

Nucleic acids can contain nucleotide analogs, including, for example, mass modified nucleotides, which allow for mass differentiation of nucleic acid molecules; nucleotides containing a detectable label such as a fluorescent, radioactive, luminescent or chemiluminescent label, which allow for detection of a nucleic acid molecule; or nucleotides containing a reactive group such as biotin or a thiol group, which facilitates immobilization of a nucleic acid molecule to a solid support. A nucleic acid also can contain one or more backbone bonds that are selectively cleavable, for example, chemically, enzymatically or photolytically cleavable. For example, a nucleic acid can include one or more deoxyribonucleotides, followed by one or more ribonucleotides, which can be followed by one or more deoxyribonucleotides, such a sequence being cleavable at the ribonucleotide sequence by base hydrolysis. A nucleic acid also can contain one or more bonds that are relatively resistant to cleavage, for example, a chimeric oligonucleotide primer, which can include nucleotides linked by peptide nucleic acid bonds and at least one nucleotide at the 3' end, which is linked by a phosphodiester bond or other suitable bond, and is capable of being extended by a polymerase. Peptide nucleic acid sequences can be prepared using well-known methods (see, for example, Weiler et al. (1997) *Nucleic Acids Res.* 25:2792-2799).

As used herein, the terms "polynucleotide" and "nucleic acid molecule" refer to an oligomer or polymer containing at least two linked nucleotides or nucleotide derivatives, including a deoxyribonucleic acid (DNA) and a ribonucleic acid (RNA), joined together, typically by phosphodiester linkages. Polynucleotides also include DNA and RNA derivatives containing, for example, a nucleotide analog or a "backbone" bond other than a phosphodiester bond, for example, a phosphotriester bond, a phosphoramidate bond, a phosphorothioate bond, a thioester bond, or a peptide bond (peptide nucleic acid). Polynucleotides (nucleic acid molecules), include single-stranded and/or double-stranded polynucleotides, such as deoxyribonucleic acid (DNA), and ribonucleic acid (RNA) as well as analogs or derivatives of either RNA or DNA. The term also includes, as equivalents, derivatives, variants and analogs of either RNA or DNA made from nucleotide analogs, single (sense or antisense) and double-stranded polynucleotides. Deoxyribonucleotides include deoxyadenosine, deoxycytidine, deoxyguanosine and deoxythymidine. For RNA, the uracil base is uridine. Polynucleotides can contain nucleotide analogs, including, for example, mass modified nucleotides, which allow for mass differentiation of polynucleotides; nucleotides containing a detectable label such as a fluorescent, radioactive, luminescent or chemiluminescent label, which allow for detection of a polynucleotide; or nucleotides containing a reactive group such as biotin or a thiol group, which facilitates immobilization of a polynucleotide to a solid support. A polynucleotide also can contain one or more backbone bonds that are selectively cleavable, for example, chemically, enzymatically or photolytically cleavable. For example, a polynucleotide can include one or more deoxyribonucleotides, followed by one or more ribonucleotides, which can be followed by one or more deoxyribonucleotides, such a sequence being cleavable at the ribonucleotide sequence by base hydrolysis. A polynucleotide also can contain one or more bonds that are relatively resistant to cleavage, for example, a chimeric oligonucleotide primer, which can include nucleotides linked by peptide nucleic acid bonds and at least one nucleotide at the 3' end, which is linked by a phosphodiester bond or other suitable bond, and is capable of being extended by a polymerase. Peptide nucleic acid sequences can be prepared using well-known methods (see, for example, Weiler et al. (1997) *Nucleic Acids Res.* 25:2792-2799). Exemplary of the nucleic acid molecules (polynucleotides) provided herein are oligonucleotides, including synthetic oligonucleotides, oligonucleotide duplexes, primers, including fill-in primers, and oligonucleotide duplex cassettes.

As used herein, a "DNA construct" is a single or double stranded, linear or circular DNA molecule that contains segments of DNA combined and juxtaposed in a manner not found in nature. DNA constructs exist as a result of human manipulation, and include clones and other copies of manipulated molecules.

As used herein, a "DNA segment" is a portion of a larger DNA molecule having specified attributes. For example, a DNA segment encoding a specified polypeptide is a portion of a longer DNA molecule, such as a plasmid or plasmid fragment, which, when read from the 5' to 3' direction, encodes the sequence of amino acids of the specified polypeptide.

As used herein, a positive strand polynucleotide refers to the "sense strand" or a polynucleotide duplex, which is complementary to the negative strand or the "antisense" strand. In the case of polynucleotides which encode genes, the sense strand is the strand that is identical to the mRNA strand that is translated into a polypeptide, while the antisense strand is complementary to that strand. Positive and negative strands of a duplex are complementary to one another.

As used herein, a genetic element refers to a gene, or any region thereof, that encodes a polypeptide or protein or region thereof. In some examples, a genetic element encodes a fusion protein.

As used herein, regulatory region of a nucleic acid molecule means a cis-acting nucleotide sequence that influences expression, positively or negatively, of an operatively linked gene. Regulatory regions include sequences of nucleotides that confer inducible (i.e., require a substance or stimulus for increased transcription) expression of a gene. When an inducer is present or at increased concentration, gene expression can be increased. Regulatory regions also include sequences that confer repression of gene expression (i.e., a substance or stimulus decreases transcription). When a repressor is present or at increased concentration gene expression can be decreased. Regulatory regions are known to influence, modulate or control many in vivo biological activities including cell proliferation, cell growth and death, cell differentiation and immune modulation. Regulatory regions typically bind to one or more trans-acting proteins, which results in either increased or decreased transcription of the gene.

Particular examples of gene regulatory regions are promoters and enhancers. Promoters are sequences located around the transcription or translation start site, typically positioned 5' of the translation start site. Promoters usually are located within 1 Kb of the translation start site, but can be located further away, for example, 2 Kb, 3 Kb, 4 Kb, 5 Kb or more, up to and including 10 Kb. Enhancers are known to influence gene expression when positioned 5' or 3' of the gene, or when positioned in or a part of an exon or an intron. Enhancers also can function at a significant distance from the gene, for example, at a distance from about 3 Kb, 5 Kb, 7 Kb, 10 Kb, 15 Kb or more.

Regulatory regions also include, in addition to promoter regions, sequences that facilitate translation, splicing signals for introns, maintenance of the correct reading frame of the gene to permit in-frame translation of mRNA and, stop codons, leader sequences and fusion partner sequences, internal ribosome binding site (IRES) elements for the creation of multigene, or polycistronic, messages, polyadenylation signals to provide proper polyadenylation of the transcript of a gene of interest and stop codons, and can be optionally included in an expression vector.

As used herein, "operably linked" with reference to nucleic acid sequences, regions, elements or domains means that the nucleic acid regions are functionally related to each other. For example, nucleic acid encoding a leader peptide can be operably linked to nucleic acid encoding a polypeptide, whereby the nucleic acids can be transcribed and translated to express a functional fusion protein, wherein the leader peptide effects secretion of the fusion polypeptide. In some instances, the nucleic acid encoding a first polypeptide (e.g., a leader peptide) is operably linked to nucleic acid encoding a second polypeptide and the nucleic acids are transcribed as a single mRNA transcript, but translation of the mRNA transcript can result in one of two polypeptides being expressed. For example, an amber stop codon can be located between the nucleic acid encoding the first polypeptide and the nucleic acid encoding the second polypeptide, such that, when introduced into a partial amber suppressor cell, the resulting single mRNA transcript can be translated to produce either a fusion protein containing the first and second polypeptides, or can be translated to produce only the first polypeptide. In another example, a promoter can be operably linked to nucleic acid encoding a polypeptide, whereby the promoter regulates or mediates the transcription of the nucleic acid.

As used herein, "synthetic," with reference to, for example, a synthetic nucleic acid molecule or a synthetic gene or a synthetic peptide refers to a nucleic acid molecule or polypeptide molecule that is produced by recombinant methods and/or by chemical synthesis methods.

As used herein, production by recombinant means by using recombinant DNA methods means the use of the well known methods of molecular biology for expressing proteins encoded by cloned DNA.

As used herein, "expression" refers to the process by which polypeptides are produced by transcription and translation of polynucleotides. The level of expression of a polypeptide can be assessed using any method known in art, including, for example, methods of determining the amount of the polypeptide produced from the host cell. Such methods can include, but are not limited to, quantitation of the polypeptide in the cell lysate by ELISA, Coomassie blue staining following gel electrophoresis, Lowry protein assay and Bradford protein assay.

As used herein, a "host cell" is a cell that is used in to receive, maintain, reproduce and amplify a vector. A host cell also can be used to express the polypeptide encoded by the vector. The nucleic acid contained in the vector is replicated when the host cell divides, thereby amplifying the nucleic acids. In one example, the host cell is a genetic package, which can be induced to express the variant polypeptide on its surface. In another example, the host cell is infected with the genetic package. For example, the host cells can be phage-display compatible host cells, which can be transformed with phage or phagemid vectors and accommodate the packaging of phage expressing fusion proteins containing the variant polypeptides.

As used herein, a "vector" is a replicable nucleic acid from which one or more heterologous proteins can be expressed when the vector is transformed into an appropriate host cell. Reference to a vector includes those vectors into which a nucleic acid encoding a polypeptide or fragment thereof can be introduced, typically by restriction digest and ligation. Reference to a vector also includes those vectors that contain nucleic acid encoding a polypeptide. The vector is used to introduce the nucleic acid encoding the polypeptide into the host cell for amplification of the nucleic acid or for expression/display of the polypeptide encoded by the nucleic acid. The vectors typically remain episomal, but can be designed to effect integration of a gene or portion thereof into a chromosome of the genome. Also contemplated are vectors that are artificial chromosomes, such as yeast artificial chromosomes and mammalian artificial chromosomes. Selection and use of such vehicles are well known to those of skill in the art.

As used herein, a vector also includes "virus vectors" or "viral vectors." Viral vectors are engineered viruses that are operatively linked to exogenous genes to transfer (as vehicles or shuttles) the exogenous genes into cells.

As used herein, an "expression vector" includes vectors capable of expressing DNA that is operatively linked with regulatory sequences, such as promoter regions, that are capable of effecting expression of such DNA fragments. Such additional segments can include promoter and terminator sequences, and optionally can include one or more origins of replication, one or more selectable markers, an enhancer, a polyadenylation signal, and the like. Expression vectors are generally derived from plasmid or viral DNA, or can contain elements of both. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome.

As used herein, the terms "oligonucleotide" and "oligo" are used synonymously. Oligonucleotides are polynucleotides that contain a limited number of nucleotides in length. Those in the art recognize that oligonucleotides generally are less than at or about two hundred fifty, typically less than at or about two hundred, typically less than at or about one hundred, nucleotides in length. Typically, the oligonucleotides provided herein are synthetic oligonucleotides. The synthetic oligonucleotides contain fewer than at or about 250 or 200 nucleotides in length, for example, fewer than about 20, 30, 40, 50, 60, 70, 80, 90, 100, 110, 120, 130, 140, 150, 160, 170, 180, 190 or 200 nucleotides in length. Typically, the oligonucleotides are single-stranded oligonucleotides. The ending "mer" can be used to denote the length of an oligonucleotide. For example, "100-mer" can be used to refer to an oligonucleotide containing 100 nucleotides in length. Exemplary of the synthetic oligonucleotides provided herein are positive and negative strand oligonucleotides, randomized oligonucleotides, reference sequence oligonucleotides, template oligonucleotides and fill-in primers are.

As used herein, synthetic oligonucleotides are oligonucleotides produced by chemical synthesis. Chemical oligonucleotide synthesis methods are well known. Any of the known synthesis methods can be used to produce the oligonucleotides designed and used in the provided methods. For example, synthetic oligonucleotides typically are made by chemically joining single nucleotide monomers or nucleotide trimers containing protective groups. Typically, phosphoramidites, single nucleotides containing protective groups are added one at a time. Synthesis typically begins with the 3' end of the oligonucleotide. The 3' most phosphoramidite is attached to a solid support and synthesis proceeds by adding each phosphoramidite to the 5' end of the last. After each addition, the protective group is removed from the 5' phosphate group on the most recently added base, allowing addition of another phosphoramidite. Automated synthesizers generally can synthesize oligonucleotides up to about 150 to about 200 nucleotides in length. Typically, the oligonucleotides designed and used in the provided methods are synthesized using standard cyanoethyl chemistry from phosphoramidite monomers. Synthetic oligonucleotides produced by this standard method can be purchased from Integrated DNA Technologies (IDT) (Coralville, Iowa) or TriLink Biotechnologies (San Diego, Calif.).

As used herein, "primer" refers to a nucleic acid molecule (more typically, to a pool of such molecules sharing sequence identity) that can act as a point of initiation of template-directed nucleic acid synthesis under appropriate conditions (for example, in the presence of four different nucleoside triphosphates and a polymerization agent, such as DNA polymerase, RNA polymerase or reverse transcriptase) in an appropriate buffer and at a suitable temperature. It will be appreciated that certain nucleic acid molecules can serve as a "probe" and as a "primer." A primer, however, has a 3' hydroxyl group for extension. A primer can be used in a variety of methods, including, for example, polymerase chain reaction (PCR), reverse-transcriptase (RT)-PCR, RNA PCR, LCR, multiplex PCR, panhandle PCR, capture PCR, expression PCR, 3' and 5' RACE, in situ PCR, ligation-mediated PCR and other amplification protocols.

As used herein, "primer pair" refers to a set of primers (e.g. two pools of primers) that includes a 5' (upstream) primer that specifically hybridizes with the 5' end of a sequence to be amplified (e.g. by PCR) and a 3' (downstream) primer that specifically hybridizes with the complement of the 3' end of the sequence to be amplified. Because "primer" can refer to a pool of identical nucleic acid molecules, a primer pair typically is a pair of two pools of primers.

As used herein, "single primer" and "single primer pool" refer synonymously to a pool of primers, where each primer in the pool contains sequence identity with the other primer members, for example, a pool of primers where the members share at least at or about 50, 55, 60, 65, 70, 75, 80, 85, 90, 95, 96, 97, 98, 99 or 100% identity. The primers in the single primer pool (all sharing sequence identity) act as 5' (upstream) primers (that specifically hybridize with the 5' end of a sequence to be amplified (e.g. by PCR)) and as 3' (downstream) primers (that specifically hybridize with the complement of the 3' end of the sequence to be amplified). Thus, the single primer can be used, without other primers, to prime synthesis of complementary strands and amplify a nucleic acid in a polymerase amplification reaction.

As used herein, complementarity, with respect to two nucleotides, refers to the ability of the two nucleotides to base pair with one another upon hybridization of two nucleic acid molecules. Two nucleic acid molecules sharing complementarity are referred to as complementary nucleic acid molecules; exemplary of complementary nucleic acid molecules are the positive and negative strands in a polynucleotide duplex. As used herein, when a nucleic acid molecule or region thereof is complementary to another nucleic acid molecule or region thereof, the two molecules or regions specifically hybridize to each other. Two complementary nucleic acid molecules can be described in terms of percent complementarity. For example, two nucleic acid molecules, each 100 nucleotides in length, that specifically hybridize with one another but contain 5 mismatches with respect to one another, are said to be 95% complementary. For two nucleic acid molecules to hybridize with 100% complementarity, it is not necessary that complementarity exist along the entire length of both of the molecules. For example, a nucleic acid molecule containing 20 contiguous nucleotides in length can specifically hybridize to a contiguous 20 nucleotide portion of a nucleic acid molecule containing 500 contiguous nucleotide in length. If no mismatches occur along this 20 nucleotide portion, the 20 nucleotide molecule hybridizes with 100% complementarity. Typically, complementary nucleic acid molecules align with less than 25%, 20%, 15%, 10%, 5% 4%, 3%, 2% or 1% mismatches between the complementary nucleotides (in other words, at least at or about 75%, 80%, 85%, 90%, 95, 96%, 97%, 98% or 99% complementarity). In another example, the complementary nucleic acid molecules contain at or about or at least at or about 50%, 55%, 60%, 65%, 70%, 75%, 80%, 85%, 90%, 95%, 96%, 97%, 98% or 99% complementarity. In one example, complementary nucleic acid molecules contain fewer than 5, 4, 3, 2 or 1 mismatched nucleotides. In one example, the complementary nucleotides are 100% complementary. If necessary, the percentage of complementarity will be specified. Typically the two molecules are selected such that they will specifically hybridize under conditions of high stringency.

As used herein, a complementary strand of a nucleic acid molecule refers to a sequence of nucleotides, e.g. a nucleic acid molecule, that specifically hybridizes to the molecule, such as the opposite strand to the nucleic acid molecule in a polynucleotide duplex. For example, in a polynucleotide duplex, the complementary strand of a positive strand oligonucleotide is a negative strand oligonucleotide that specifically hybridizes to the positive strand oligonucleotide in a duplex. In one example of the provided methods, polymerase reactions are used to synthesize complementary strands of polynucleotides to form duplexes, typically beginning by hybridizing an oligonucleotide primer to the polynucleotide.

As used herein, "specifically hybridizes" refers to annealing, by complementary base-pairing, of a nucleic acid molecule (e.g. an oligonucleotide or polynucleotide) to another nucleic acid molecule. Those of skill in the art are familiar with in vitro and in vivo parameters that affect specific hybridization, such as length and composition of the particular molecule. Parameters particularly relevant to in vitro hybridization further include annealing and washing temperature, buffer composition and salt concentration. It is not necessary that two nucleic acid molecules exhibit 100% complementarity in order to specifically hybridize to one another. For example, two complementary nucleic acid molecules sharing sequence complementarity, such as at or about or at least or about 99%, 98%, 97%, 96%, 95%, 90%, 85%, 80%, 75%, 70%, 65%, 60%, 55% or 50% complementarity, can specifically hybridize to one another. Parameters, for example, buffer components, time and temperature, used in in vitro hybridization methods provided herein, can be adjusted in stringency to vary the percent complementarity required for specific hybridization of two nucleic acid molecules. The skilled person can readily adjust these parameters to achieve specific hybridization of a nucleic acid molecule to a target nucleic acid molecule appropriate for a particular application.

As used herein, "primary sequence" refers to the sequence of amino acid residues in a polypeptide or the sequence of nucleotides in a nucleic acid molecule.

As used herein, "similarity" between two proteins or nucleic acids refers to the relatedness between the sequence of amino acids of the proteins or the nucleotide sequences of the nucleic acids. Similarity can be based on the degree of identity of sequences of residues and the residues contained therein. Methods for assessing the degree of similarity between proteins or nucleic acids are known to those of skill in the art. For example, in one method of assessing sequence similarity, two amino acid or nucleotide sequences are aligned in a manner that yields a maximal level of identity between the sequences. "Identity" refers to the extent to which the amino acid or nucleotide sequences are invariant. Alignment of amino acid sequences, and to some extent nucleotide sequences, also can take into account conservative differences and/or frequent substitutions in amino acids (or nucleotides). Conservative differences are those that preserve the physico-chemical properties of the residues involved. Alignments can be global (alignment of the compared sequences over the entire length of the sequences and including all residues) or local (the alignment of a portion of the sequences that includes only the most similar region or regions).

As used herein, when a polypeptide or nucleic acid molecule or region thereof contains or has "identity" or "homology" to another polypeptide or nucleic acid molecule or region, the two molecules and/or regions share greater than or equal to at or about 40% sequence identity, and typically greater than or equal to at or about 50% sequence identity, such as at least or about 60%, 65%, 70%, 75%, 80%, 85%, 90%, 95%, 96%, 97%, 98%, 99% or 100% sequence identity; the precise percentage of identity can be specified if necessary. A nucleic acid molecule, or region thereof, that is identical or homologous to a second nucleic acid molecule or region can specifically hybridize to a nucleic acid molecule or region that is 100% complementary to the second nucleic acid molecule or region. Identity alternatively can be compared between two theoretical nucleotide or amino acid sequences or between a nucleic acid or polypeptide molecule and a theoretical sequence.

Sequence "identity," per se, has an art-recognized meaning and the percentage of sequence identity between two nucleic acid or polypeptide molecules or regions can be calculated using published techniques. Sequence identity can be measured along the full length of a polynucleotide or polypeptide or along a region of the molecule. (See, e.g.: *Computational Molecular Biology, Lesk, A. M., ed., Oxford University Press, New York,* 1988; *Biocomputing: Informatics and Genome Projects*, Smith, D. W., ed., Academic Press, New York, 1993; *Computer Analysis of Sequence Data*, Part I, Griffin, A. M., and Griffin, H. G., eds., Humana Press, New Jersey, 1994; *Sequence Analysis in Molecular Biology*, von Heinje, G., Academic Press, 1987; and Sequence Analysis Primer, Gribskov, M. and Devereux, J., eds., M Stockton Press, New York, 1991). While there exist a number of methods to measure identity between two polynucleotide or polypeptides, the term "identity" is well known to skilled artisans (Carrillo, H. & Lipman, D., *SIAM J Applied Math* 48:1073 (1988)).

Sequence identity compared along the full length of two polynucleotides or polypeptides refers to the percentage of identical nucleotide or amino acid residues along the full-length of the molecule. For example, if a polypeptide A has 100 amino acids and polypeptide B has 95 amino acids, which are identical to amino acids 1-95 of polypeptide A, then polypeptide B has 95% identity when sequence identity is compared along the full length of a polypeptide A compared to full length of polypeptide B. Alternatively, sequence identity between polypeptide A and polypeptide B can be compared along a region, such as a 20 amino acid analogous region, of each polypeptide. In this case, if polypeptide A and B have 20 identical amino acids along that region, the sequence identity for the regions is 100%. Alternatively, sequence identity can be compared along the length of a molecule, compared to a region of another molecule. Alternatively, sequence identity between polypeptide A and polypeptide B can be compared along the same length polypeptide but with amino acid replacements, such as conservative amino acid replacements or non-conservative amino acid replacements. As discussed below, and known to those of skill in the art, various programs and methods for assessing identity are known to those of skill in the art. High levels of identity, such as 90% or 95% identity, readily can be determined without software.

Whether any two nucleic acid molecules have nucleotide sequences that are at least or about 60%, 70%, 80%, 85%, 90%, 95%, 96%, 97%, 98% or 99% "identical" can be determined using known computer algorithms such as the "FASTA" program, using for example, the default parameters as in Pearson et al. (1988) *Proc. Natl. Acad. Sci. USA* 85:2444 (other programs include the GCG program package (Devereux, J. et al. (1984) *Nucleic Acids Research* 12(1):387), BLASTP, BLASTN, FASTA (Altschul, S. F. et al. (1990) *J. Molec. Biol.* 215:403; Guide to Huge Computers, Martin J. Bishop, ed., Academic Press, San Diego, 1994, and Carrillo et al. (1988) *SIAM J Applied Math* 48:1073). For example, the BLAST function of the National Center for Biotechnology Information database can be used to determine identity. Other commercially or publicly available programs include, DNAStar "MegAlign" program (Madison, Wis.) and the University of Wisconsin Genetics Computer Group (UWG) "Gap" program (Madison Wis.)). Percent homology or identity of proteins and/or nucleic acid molecules can be determined, for example, by comparing sequence information using a GAP computer program (e.g., Needleman et al. (1970) *J. Mol. Biol.* 48:443, as revised by Smith and Waterman ((1981) *Adv. Appl. Math.* 2:482). Briefly, the GAP program defines similarity as the number of aligned symbols (i.e., nucleotides or amino acids), which are similar, divided by the total number of symbols in the shorter of the two sequences. Default parameters for the GAP program can include: (1) a unary comparison matrix (containing a value of 1 for identities and 0 for non-identities) and the weighted comparison matrix of Gribskov et al. (1986) *Nucl. Acids Res.* 14:6745, as described by Schwartz and Dayhoff, eds., *ATLAS OF PROTEIN SEQUENCE AND STRUCTURE*, National Biomedical Research Foundation, pp. 353-358 (1979); (2) a penalty of 3.0 for each gap and an additional 0.10 penalty for each symbol in each gap; and (3) no penalty for end gaps.

In general, for determination of the percentage sequence identity, sequences are aligned so that the highest order match is obtained (see, e.g.: *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data, Part I*, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991; Carrillo et al. (1988) *SIAM J Applied Math* 48:1073). For sequence identity, the number of conserved amino acids is determined by standard alignment algorithms programs, and can be used with default gap penalties established by each supplier. Substantially homologous nucleic acid molecules specifically hybridize typically at moderate stringency or at high stringency all along the length of the nucleic acid of interest. Also contemplated are nucleic acid molecules that contain degenerate codons in place of codons in the hybridizing nucleic acid molecule.

Therefore, the term "identity," when associated with a particular number, represents a comparison between the sequences of a first and a second polypeptide or polynucleotide or regions thereof and/or between theoretical nucleotide or amino acid sequences. As used herein, the term at least "90% identical to" refers to percent identities from 90 to 99.99 relative to the first nucleic acid or amino acid sequence of the polypeptide. Identity at a level of 90% or more is indicative of the fact that, assuming for exemplification purposes, a first and second polypeptide length of 100 amino acids are compared, no more than 10% (i.e., 10 out of 100) of the amino acids in the first polypeptide differs from that of the second polypeptide. Similar comparisons can be made between first and second polynucleotides. Such differences among the first and second sequences can be represented as point mutations randomly distributed over the entire length of a polypeptide or they can be clustered in one or more locations of varying length up to the maximum allowable, e.g. 10/100 amino acid difference (approximately 90% identity). Differences are defined as nucleotide or amino acid residue substitutions, insertions, additions or deletions. At the level of homologies or identities above about 85-90%, the result is independent of the program and gap parameters set; such high levels of identity can be assessed readily, often by manual alignment without relying on software.

As used herein, alignment of a sequence refers to the use of homology to align two or more sequences of nucleotides or amino acids. Typically, two or more sequences that are related by 50% or more identity are aligned. An aligned set of sequences refers to 2 or more sequences that are aligned at corresponding positions and can include aligning sequences derived from RNAs, such as ESTs and other cDNAs, aligned with genomic DNA sequence.

Related or variant polypeptides or nucleic acid molecules can be aligned by any method known to those of skill in the art. Such methods typically maximize matches, and include methods, such as using manual alignments and by using the numerous alignment programs available (e.g., BLASTP) and others known to those of skill in the art. By aligning the sequences of polypeptides or nucleic acids, one skilled in the art can identify analogous portions or positions, using conserved and identical amino acid residues as guides. Further, one skilled in the art also can employ conserved amino acid or nucleotide residues as guides to find corresponding amino acid or nucleotide residues between and among human and non-human sequences. Corresponding positions also can be based on structural alignments, for example by using computer simulated alignments of protein structure. In other instances, corresponding regions can be identified. One skilled in the art also can employ conserved amino acid residues as guides to find corresponding amino acid residues between and among human and non-human sequences.

As used herein, "analogous" and "corresponding" portions, positions or regions are portions, positions or regions that are aligned with one another upon aligning two or more related polypeptide or nucleic acid sequences (including sequences of molecules, regions of molecules and/or theoretical sequences) so that the highest order match is obtained, using an alignment method known to those of skill in the art to maximize matches. In other words, two analogous positions (or portions or regions) align upon best-fit alignment of two or more polypeptide or nucleic acid sequences. The analogous portions/positions/regions are identified based on position along the linear nucleic acid or amino acid sequence when the two or more sequences are aligned. The analogous portions need not share any sequence similarity with one another. For example, alignment (such that maximizing matches) of the sequences of two homologous nucleic acid molecules, each 100 nucleotides in length, can reveal that 70 of the 100 nucleotides are identical. Portions of these nucleic acid molecules containing some or all of the other non-identical 30 amino acids are analogous portions that do not share sequence identity. Alternatively, the analogous portions can contain some percentage of sequence identity to one another, such as at or about 50%, 55%, 60%, 65%, 70%, 75%, 80%, 85%, 90%, 95%, 96%, 97%, 98%, 99%, or fractions thereof. In one example, the analogous portions are 100% identical.

As used herein, a "modification" is in reference to modification of a sequence of amino acids of a polypeptide or a sequence of nucleotides in a nucleic acid molecule and includes deletions, insertions, and replacements of amino acids and nucleotides, respectively. Methods of modifying a polypeptide are routine to those of skill in the art, such as by using recombinant DNA methodologies.

As used herein, "deletion," when referring to a nucleic acid or polypeptide sequence, refers to the deletion of one or more nucleotides or amino acids compared to a sequence, such as a target polynucleotide or polypeptide or a native or wild-type sequence.

As used herein, "insertion" when referring to a nucleic acid or amino acid sequence, describes the inclusion of one or more additional nucleotides or amino acids, within a target, native, wild-type or other related sequence. Thus, a nucleic acid molecule that contains one or more insertions compared to a wild-type sequence, contains one or more additional nucleotides within the linear length of the sequence. As used herein, "additions," to nucleic acid and amino acid sequences describe addition of nucleotides or amino acids onto either termini compared to another sequence.

As used herein, "substitution" refers to the replacing of one or more nucleotides or amino acids in a native, target, wild-type or other nucleic acid or polypeptide sequence with an alternative nucleotide or amino acid, without changing the length (as described in numbers of residues) of the molecule. Thus, one or more substitutions in a molecule does not change the number of amino acid residues or nucleotides of the molecule. Substitution mutations compared to a particular polypeptide can be expressed in terms of the number of the amino acid residue along the length of the polypeptide sequence. For example, a modified polypeptide having a modification in the amino acid at the $19^{th}$ position of the amino acid sequence that is a substitution of Isoleucine (Ile; I) for cysteine (Cys; C) can be expressed as I19C, Ile19C, or simply C19, to indicate that the amino acid at the modified $19^{th}$ position is a cysteine. In this example, the molecule having the substitution has a modification at Ile 19 of the unmodified polypeptide.

As used herein, a binding property is a characteristic of a molecule, e.g. a polypeptide, relating to whether or not, and how, it binds one or more binding partners. Binding properties include ability to bind the binding partner(s), the affinity with which it binds to the binding partner (e.g. high affinity), the avidity with which it binds to the binding partner, the strength of the bond with the binding partner and specificity for binding with the binding partner.

As used herein, affinity describes the strength of the interaction between two or more molecules, such as binding partners, typically the strength of the noncovalent interactions between two binding partners. The affinity of an antibody or antigen-binding fragment thereof for an antigen epitope is the measure of the strength of the total noncovalent interactions between a single antibody combining site and the epitope. Low-affinity antibody-antigen interactionis weak, and the molecules tend to dissociate rapidly, while high affinity antibody-antigen-binding is strong and the molecules remain bound for a longer amount of time. Methods for calculating affinity are well known, such as methods for determining association/dissociation constants. Affinity can be estimated empirically or affinities can be determined comparatively, e.g. by comparing the affinity of one antibody and another antibody for a particular antigen.

As used herein, antibody avidity refers to the strength of multiple interactions between a multivalent antibody and its cognate antigen, such as with antibodies containing multiple binding sites associated with an antigen with repeating epitopes or an epitope array. A high avidity antibody has a higher strength of such interactions compared with a low avidity antibody.

As used herein, "bind" refers to the participation of a molecule in any attractive interaction with another molecule, resulting in a stable association in which the two molecules are in close proximity to one another. Binding includes, but is not limited to, non-covalent bonds, covalent bonds (such as reversible and irreversible covalent bonds), and includes interactions between molecules such as, but not limited to, proteins, nucleic acids, carbohydrates, lipids, and small molecules, such as chemical compounds including drugs. Exemplary of bonds are antibody-antigen interactions and receptor-ligand interactions. When an antibody "binds" a particular antigen, bind refers to the specific recognition of the antigen by the antibody, through cognate antibody-antigen interaction, at antibody combining sites. Binding also can include association of multiple chains of a polypeptide, such as antibody chains which interact through disulfide bonds.

As used herein, "affinity constant" refers to an association constant (Ka) used to measure the affinity of an antibody for an antigen. The higher the affinity constant the greater the affinity of the antibody for the antigen. Affinity constants are expressed in units of reciprocal molarity (i.e. $M^{-1}$) and can be calculated from the rate constant for the association-dissociation reaction as measured by standard kinetic methodology for antibody reactions (e.g., immunoassays, surface plasmon resonance, or other kinetic interaction assays known in the art).

As used herein, the term "the same," when used in reference to antibody binding affinity, means that the association constant (Ka) is within about 1 to 100 fold or 1 to 10 fold of the reference antibody (1-100 fold greater affinity or 1-100 fold less affinity, or any numerical value or range or value within such ranges, than the reference antibody).

As used herein, "substantially the same" when used in reference to association constant (Ka), means that the association constant is within about 5 to 5000 fold greater or less than the association constant, Ka, of the reference antibody (5-5000 fold greater or 5-5000 fold less than the reference antibody). The binding affinity of an antibody also can be expressed as a dissociation constant, or Kd. The dissociation constant is the reciprocal of the association constant, Kd=1/Ka.

As used herein, the phase "having the same binding specificity" when used to describe an antibody in reference to another antibody, means that the antibody specifically binds (immunospecifically binds or specifically binds to the virus) to all or a part of the same antigenic epitope as the reference antibody. Thus, an anti-RSV antibody or antigen-binding fragment thereof having the same binding specificity as the antibody denoted as 58c5 specifically binds to all or a part of the same epitope as the anti-RSV antibody or antigen-binding fragment thereof denoted as 58c5. The epitope can be in the isolated protein, or in the protein in the virus. The ability of two antibodies to bind to the same epitope can be determined by known assays in the art such as, for example, surface plasmon resonance assays and antibody competition assays. Typically, antibodies that immunospecifically bind to the same epitope can compete for binding to the epitope, which can be measured, for example, by an in vitro binding competition assay (e.g. competition ELISA), using techniques known the art. Typically, a first antibody that immunospecifically binds to the same epitope as a second antibody can compete for binding to the epitope by about or 30%, 35%, 40%, 45%, 50%, 55%, 60%, 65%, 70%, 75%, 80%, 85%, 90%, 95%, 100%, where the percentage competition is measured ability of the second antibody to displace binding of the first antibody to the epitope. In exemplary competition assays, the antigen is incubated in the presence a predetermined limiting dilution of a labeled antibody (e.g., 50-70% saturation concentration), and serial dilutions of an unlabeled competing antibody. Competition is determined by measuring the binding of the labeled antibody to the antigen for any decreases in binding in the presence of the competing antibody. Variations of such assays, including various labeling techniques and detection methods including, for example, radiometric, fluorescent, enzymatic and colorimetric detection, are known in the art. The ability of a first antibody to bind to the same epitope as a second antibody also can be determined, for example, by virus neutralization assays using Monoclonal Antibody-Resistant Mutants (MARMs). For example, where a first anti-RSV antibody neutralizes wild-type RSV but not a particular mutant RSV, a second antibody that neutralizes the wild-type RSV but not the particular mutant RSV generally binds the same epitope on RSV as the first antibody. Where a first anti-RSV antibody neutralizes wild-type RSV but not a particular mutant RSV, a second antibody that neutralizes the wild-type RSV and the particular mutant RSV generally does not bind the same epitope on RSV as the first antibody.

As used herein, a "monoclonal antibody resistant mutant" (MARM) also referred to as a "monoclonal antibody escape mutant" is a mutant respiratory syncytial virus (RSV) that exhibits increased resistance to neutralization by a monoclonal antibody that neutralizes the wildtype RSV virus. MARMs are generated by culturing wildtype RSV in the presence of a monoclonal antibody over successive rounds of viral replication in the presence of the antibody such that after each successive round of virus replication, increasing concentrations of antibody are required to produce virus neutralization effects. Cytopathic effects (CPE) are only observed in the presence of increasing concentrations of antibodies until a mutant virus results that is no longer efficiently neutralized by the antibody. If more rounds of replication are require for the emergence of a MARM in the presence of a first antibody compared to a second antibody, one can conclude the first antibody binds to an epitope that is different from the epitope to which the second antibody binds. If a first antibody can neutralize a MARM generated against a second antibody, one can conclude that the antibodies specifically bind to or interact with different epitopes. MARMs can more finely map the antigen binding epitope of an antibody as compared to a competition binding assay, such that one antibody can compete against another for binding to an antigen, but can still neutralize the MARM of its competitor.

As used herein, $EC_{50}$ refers to the effective concentration at which an antibody can inhibit virus infection 50% in an in vitro neutralization assay, such as, for example, a virus plaque reduction assay as described herein (e.g., a plaque reduction assay using Vero host cells or other host cell for infection) or other virus neutralization assays known in the art. Typically, a neutralizing virus is one that has an $EC_{50}$ of 2 nM or less for inhibition of the virus in an in vitro neutralization assay, such as a virus plaque reduction assay.

As used herein, "binding partner" refers to a molecule (such as a polypeptide, lipid, glycolipid, nucleic acid molecule, carbohydrate or other molecule), with which another molecule specifically interacts, for example, through covalent or noncovalent interactions, such as the interaction of an antibody with cognate antigen. The binding partner can be naturally or synthetically produced. In one example, desired variant polypeptides are selected using one or more binding partners, for example, using in vitro or in vivo methods. Exemplary of the in vitro methods include selection using a binding partner coupled to a solid support, such as a bead, plate, column, matrix or other solid support; or a binding partner coupled to another selectable molecule, such as a biotin molecule, followed by subsequent selection by coupling the other selectable molecule to a solid support. Typically, the in vitro methods include wash steps to remove unbound polypeptides, followed by elution of the selected variant polypeptide(s). The process can be repeated one or more times in an iterative process to select variant polypeptides from among the selected polypeptides.

As used herein, a disulfide bond (also called an S—S bond or a disulfide bridge) is a single covalent bond derived from the coupling of thiol groups. Disulfide bonds in proteins are formed between the thiol groups of cysteine residues, and stabilize interactions between polypeptide domains, such as antibody domains.

As used herein, “coupled” or “conjugated” means attached via a covalent or noncovalent interaction.

As used herein, the phrase “conjugated to an antibody” or “linked to an antibody” or grammatical variations thereof, when referring to the attachment of a moiety to an antibody or antigen-binding fragment thereof, such as a diagnostic or therapeutic moiety, means that the moiety is attached to the antibody or antigen-binding fragment thereof by any known means for linking peptides, such as, for example, by production of fusion protein by recombinant means or post-translationally by chemical means. Conjugation can employ any of a variety of linking agents to effect conjugation, including, but not limited to, peptide or compound linkers or chemical cross-linking agents.

As used herein, “phage display” refers to the expression of polypeptides on the surface of filamentous bacteriophage.

As used herein, a “phage-display compatible cell” or “phage-display compatible host cell” is a host cell, typically a bacterial host cell, that can be infected by phage and thus can support the production of phage displaying fusion proteins containing polypeptides, e.g., variant polypeptides and can thus be used for phage display. Exemplary of phage display compatible cells include, but are not limited to, XL1-blue cells.

As used herein, “panning” refers to an affinity-based selection procedure for the isolation of phage displaying a molecule with a specificity for a binding partner, for example, a capture molecule (e.g. an antigen) or sequence of amino acids or nucleotides or epitope, region, portion or locus therein.

As used herein, “display protein” or “genetic package display protein” means any genetic package polypeptide for display of a polypeptide on the genetic package, such that when the display protein is fused to (e.g. included as part of a fusion protein with) a polypeptide of interest (e.g., a polypeptide for which reduced expression is desired), the polypeptide is displayed on the outer surface of the genetic package. The display protein typically is present on or within the outer surface or outer compartment of a genetic package (e.g., membrane, cell wall, coat or other outer surface or compartment) of a genetic package, e.g. a viral genetic package, such as a phage, such that upon fusion to a polypeptide of interest, the polypeptide is displayed on the genetic package.

As used herein, a coat protein is a display protein, at least a portion of which is present on the outer surface of the genetic package, such that when it is fused to the polypeptide of interest, the polypeptide is displayed on the outer surface of the genetic package. Typically, the coat proteins are viral coat proteins, such as phage coat proteins. A viral coat protein, such as a phage coat protein associates with the virus particle during assembly in a host cell. In one example, coat proteins are used herein for display of polypeptides on genetic packages; the coat proteins are expressed as portions of fusion proteins, which contain the coat protein sequence of amino acids and a sequence of amino acids of the displayed polypeptide. The coat protein can be a full-length coat protein or any portion thereof capable of effecting display of the polypeptide on the surface of the genetic package.

Exemplary of coat proteins are phage coat proteins, such as, but not limited to, (i) minor coat proteins of filamentous phage, such as gene III protein (gIIIp, cp3), and (ii) major coat proteins (which are present in the viral coat at 10 copies or more, for example, tens, hundreds or thousands of copies) of filamentous phage such as gene VIII protein (gVIIIp, cp8); fusions to other phage coat proteins such as gene VI protein, gene VII protein, or gene IX protein (see, e.g., WO 00/71694); and portions (e.g., domains or fragments) of these proteins, such as, but not limited to domains that are stably incorporated into the phage particle, e.g. such as the anchor domain of gIIIp, or gVIIIp. Additionally, mutants of gVIIIp can be used which are optimized for expression of larger peptides, such as mutants having improved surface display properties, such as mutant gVIIp (see, for example, Sidhu et al. (2000) *J. Mol. Biol.* 296:487-495).

As used herein, “disease or disorder” refers to a pathological condition in an organism resulting from cause or condition including, but not limited to, infections, acquired conditions, genetic conditions, and characterized by identifiable symptoms. Diseases and disorders of interest herein are those involving RSV infection or those that increase the risk of a RSV infection.

As used herein, “infection” and “RSV infection” refer to all stages of a RSV life cycle in a host (including, but not limited to the invasion by and replication of RSV in a cell or body tissue), as well as the pathological state resulting from the invasion by and replication of a RSV. The invasion by and multiplication of a RSV includes, but is not limited to, the following steps: the docking of the RSV particle to a cell, fusion of a virus with a cell membrane, the introduction of viral genetic information into a cell, the expression of RSV proteins, the production of new RSV particles and the release of RSV particles from a cell. A RSV infection can be an upper respiratory tract RSV infection (URI), a lower respiratory tract RSV infection (LRI), or a combination thereof. In some examples, the pathological state resulting from the invasion by and replication of a RSV is an acute RSV disease.

As used herein, “acute RSV disease” refers to clinically significant disease in the lungs or lower respiratory tract as a result of a RSV infection, which can manifest as pneumonia and/or bronchiolitis, where such symptoms can include, for example, hypoxia, apnea, respiratory distress, rapid breathing, wheezing, and cyanosis. Acute RSV disease requires an affected individual to obtain medical intervention, such as hospitalization, administration of oxygen, intubation and/or ventilation.

As used herein, “treating” a subject with a disease or condition means that the subject’s symptoms are partially or totally alleviated, or remain static following treatment. Hence treatment encompasses prophylaxis, therapy and/or cure. Prophylaxis refers to prevention of a potential disease and/or a prevention of worsening of symptoms or progression of a disease. Treatment also encompasses any pharmaceutical use of any antibody or antigen-binding fragment thereof provided or compositions provided herein.

As used herein, “prevention” or prophylaxis, and grammatically equivalent forms thereof, refers to methods in which the risk of developing disease or condition is reduced.

As used herein, a “pharmaceutically effective agent” includes any therapeutic agent or bioactive agents, including, but not limited to, for example, anesthetics, vasoconstrictors, dispersing agents, conventional therapeutic drugs, including small molecule drugs and therapeutic proteins.

As used herein, a “therapeutic effect” means an effect resulting from treatment of a subject that alters, typically improves or ameliorates the symptoms of a disease or condition or that cures a disease or condition.

As used herein, a “therapeutically effective amount” or a “therapeutically effective dose” refers to the quantity of an agent, compound, material, or composition containing a compound that is at least sufficient to produce a therapeutic effect following administration to a subject. Hence, it is the quantity necessary for preventing, curing, ameliorating, arresting or partially arresting a symptom of a disease or disorder.

As used herein, "therapeutic efficacy" refers to the ability of an agent, compound, material, or composition containing a compound to produce a therapeutic effect in a subject to whom the an agent, compound, material, or composition containing a compound has been administered.

As used herein, a "prophylactically effective amount" or a "prophylactically effective dose" refers to the quantity of an agent, compound, material, or composition containing a compound that when administered to a subject, will have the intended prophylactic effect, e.g., preventing or delaying the onset, or reoccurrence, of disease or symptoms, reducing the likelihood of the onset, or reoccurrence, of disease or symptoms, or reducing the incidence of viral infection. The full prophylactic effect does not necessarily occur by administration of one dose, and can occur only after administration of a series of doses. Thus, a prophylactically effective amount can be administered in one or more administrations.

As used herein, the terms "immunotherapeutically" or "immunotherapy" in conjunction with antibodies provided denotes prophylactic as well as therapeutic administration. Thus, the therapeutic antibodies provided can be administered to a subject at risk of contracting a virus infection (e.g. a RSV infection) in order to lessen the likelihood and/or severity of the disease, or administered to subjects already evidencing active virus infection (e.g. a RSV infection).

As used herein, amelioration of the symptoms of a particular disease or disorder by a treatment, such as by administration of a pharmaceutical composition or other therapeutic, refers to any lessening, whether permanent or temporary, lasting or transient, of the symptoms that can be attributed to or associated with administration of the composition or therapeutic.

As used herein, the term "diagnostically effective" amount refers to the quantity of an agent, compound, material, or composition containing a detectable compound that is at least sufficient for detection of the compound following administration to a subject. Generally, a diagnostically effective amount of an anti-RSV antibody or antigen-binding fragment thereof, such as a detectably-labeled antibody or antigen-binding fragment thereof or an antibody or antigen-binding fragment thereof that can be detected by a secondary agent, administered to a subject for detection is quantity of the antibody or antigen-binding fragment thereof which is sufficient to enable detection of the site having the RSV antigen for which the antibody or antigen-binding fragment thereof is specific. In using the antibodies provided herein for the in vivo detection of antigen, a detectably labeled antibody or antigen-binding fragment thereof is given in a dose which is diagnostically effective.

As used herein, a label or detectable moiety is a detectable marker (e.g., a fluorescent molecule, chemiluminescent molecule, a bioluminescent molecule, a contrast agent (e.g., a metal), a radionuclide, a chromophore, a detectable peptide, or an enzyme that catalyzes the formation of a detectable product) that can be attached or linked directly or indirectly to a molecule (e.g., an anti-RSV antibody or antigen-binding fragment thereof provided herein) or associated therewith and can be detected in vivo and/or in vitro. The detection method can be any method known in the art, including known in vivo and/or in vitro methods of detection (e.g., imaging by visual inspection, magnetic resonance (MR) spectroscopy, ultrasound signal, X-ray, gamma ray spectroscopy (e.g., positron emission tomography (PET) scanning, single-photon emission computed tomography (SPECT)), fluorescence spectroscopy or absorption). Indirect detection refers to measurement of a physical phenomenon, such as energy or particle emission or absorption, of an atom, molecule or composition that binds directly or indirectly to the detectable moiety (e.g., detection of a labeled secondary antibody or antigen-binding fragment thereof that binds to a primary antibody (e.g., an anti-RSV antibody or antigen-binding fragment thereof provided herein).

As used herein, the term "subject" refers to an animal, including a mammal, such as a human being.

As used herein, a patient refers to a human subject.

As used herein, animal includes any animal, such as, but are not limited to primates including humans, gorillas and monkeys; rodents, such as mice and rats; fowl, such as chickens; ruminants, such as goats, cows, deer, sheep; ovine, such as pigs and other animals. Non-human animals exclude humans as the contemplated animal. The polypeptides provided herein are from any source, animal, plant, prokaryotic and fungal. Most polypeptides are of animal origin, including mammalian origin.

As used herein, a "elderly," refers to refers to a subject, who due to age has a decreased immune response and has a decreased response to vaccination. Typically, an elderly subject is one that is human that is sixty-five and greater years of age, more typically, 70 and greater years of age.

As used herein, a "human infant" refers to a human less than or about 24 months (e.g., less than or about 16 months, less than or about 12 months, less than or about 6 months, less than or about 3 months, less than or about 2 months, or less than or about 1 month of age). Typically, the human infant is born at more than 38 weeks of gestational age.

As used herein, a "human infant born prematurely" refers to a human born at less than or about 40 weeks gestational age, typically, less than or about 38 weeks gestational age.

As used herein, a "unit dose form" refers to physically discrete units suitable for human and animal subjects and packaged individually as is known in the art.

As used herein, a "single dosage formulation" refers to a formulation for direct administration.

As used herein, an "article of manufacture" is a product that is made and sold. As used throughout this application, the term is intended to encompass any of the compositions provided herein contained in articles of packaging.

As used herein, a "fluid" refers to any composition that can flow. Fluids thus encompass compositions that are in the form of semi-solids, pastes, solutions, aqueous mixtures, gels, lotions, creams and other such compositions.

As used herein, an isolated or purified polypeptide or protein (e.g. an isolated antibody or antigen-binding fragment thereof) or biologically-active portion thereof (e.g. an isolated antigen-binding fragment) is substantially free of cellular material or other contaminating proteins from the cell or tissue from which the protein is derived, or substantially free from chemical precursors or other chemicals when chemically synthesized. Preparations can be determined to be substantially free if they appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification does not detectably alter the physical and chemical properties, such as enzymatic and biological activities, of the substance. Methods for purification of the compounds to produce substantially chemically pure compounds are known to those of skill in the art. A substantially chemically pure compound, however, can be a mixture of stereoisomers. In such instances, further purification might increase the specific activity of the compound. As used herein, a "cellular extract" or "lysate" refers to a preparation or fraction which is made from a lysed or disrupted cell.

As used herein, isolated nucleic acid molecule is one which is separated from other nucleic acid molecules which are present in the natural source of the nucleic acid molecule. An "isolated" nucleic acid molecule, such as a cDNA molecule, can be substantially free of other cellular material, or culture medium when produced by recombinant techniques, or substantially free of chemical precursors or other chemicals when chemically synthesized. Exemplary isolated nucleic acid molecules provided herein include isolated nucleic acid molecules encoding an antibody or antigen-binding fragments provided.

As used herein, a "control" refers to a sample that is substantially identical to the test sample, except that it is not treated with a test parameter, or, if it is a plasma sample, it can be from a normal volunteer not affected with the condition of interest. A control also can be an internal control.

As used herein, a "composition" refers to any mixture. It can be a solution, suspension, liquid, powder, paste, aqueous, non-aqueous or any combination thereof.

As used herein, a "combination" refers to any association between or among two or more items. The combination can be two or more separate items, such as two compositions or two collections, can be a mixture thereof, such as a single mixture of the two or more items, or any variation thereof. The elements of a combination are generally functionally associated or related.

As used herein, combination therapy refers to administration of two or more different therapeutics, such as two or more different anti-RSV antibodies and/or anti-RSV antibodies and antigen-binding fragments thereof. The different therapeutic agents can be provided and administered separately, sequentially, intermittently, or can be provided in a single composition.

As used herein, a kit is a packaged combination that optionally includes other elements, such as additional reagents and instructions for use of the combination or elements thereof, for a purpose including, but not limited to, activation, administration, diagnosis, and assessment of a biological activity or property.

As used herein, the singular forms "a," "an" and "the" include plural referents unless the context clearly dictates otherwise. Thus, for example, reference to a polypeptide, comprising "an immunoglobulin domain" includes polypeptides with one or a plurality of immunoglobulin domains.

As used herein, the term "or" is used to mean "and/or" unless explicitly indicated to refer to alternatives only or the alternatives are mutually exclusive.

As used herein, ranges and amounts can be expressed as "about" a particular value or range. About also includes the exact amount. Hence "about 5 amino acids" means "about 5 amino acids" and also "5 amino acids."

As used herein, "optional" or "optionally" means that the subsequently described event or circumstance does or does not occur and that the description includes instances where said event or circumstance occurs and instances where it does not. For example, an optionally variant portion means that the portion is variant or non-variant.

As used herein, the abbreviations for any protective groups, amino acids and other compounds, are, unless indicated otherwise, in accord with their common usage, recognized abbreviations, or the IUPAC-IUB Commission on Biochemical Nomenclature (see, *Biochem.* (1972) 11(9):1726-1732).

B. OVERVIEW

Provided are anti-RSV antibodies or antigen-binding fragments thereof that bind to and neutralize respiratory syncytial virus. The anti-RSV antibodies provided herein are neutralizing antibodies that recognize one or more epitopes on the surface of RSV. In particular, the antibodies provided herein bind to a RSV fusion (F) protein. The antibodies provided herein can be used in prophylaxis therapies. The antibodies provided herein also can be used as therapeutics.

For example, the antibodies provided can be employed for the prevention and/or spread of pathogenic disease, including, but not limited to the inhibition of viral transmission between subjects, inhibition of establishment of viral infection in a host, and reduction of viral load in a subject. The antibodies also can be employed for preventing, treating, and/or alleviating one or more symptoms of a RSV infection or for reducing the duration of a RSV infection. Accordingly, treatment of patients with antibodies provided herein can decrease the mortality and/or morbidity rate associated with RSV infection.

RSV persistence is associated with the generation of escape mutants that cannot be neutralized by an antibody. Thus, the main challenges to development of therapeutic anti-viral antibodies are the generation or identification of antibodies that have a neutralization epitope that is 1) conserved across various strains or serotypes and 2) is difficult for the evolving virus to generate escape mutants against. Antibodies provided herein bind to various RSV subgroups and strains. Antibodies provided herein also exhibit improved virus neutralization activity compared to existing antibodies in the prior art. The provided antibodies effectively neutralize virus over successive rounds of replication, where RSV typically would generate escape mutants to resist neutralization. The ability to limit the generation of MARMs means that the antibodies provided herein bind to an epitope that is less susceptible to variation in the form of generated escape mutants. This epitope, therefore, is different from epitopes of other known anti-RSV antibodies. Thus, the provided anti-RSV antibodies, in addition to prophylaxis therapy, also are useful for the treatment of RSV infection. Currently, there are no known approved antibody therapeutics against RSV infection. As such, the antibodies provided herein are especially important for treatment of RSV infection among elderly patients, for example those in group or retirement homes, where proximity increases the risk for viral spread among patients. Treatment with the antibodies provided herein is also important in situations where non-compliance with dosage regimes increases risk for viral escape, as non-compliance in the prophylaxis treatment of RSV with palivizumab is increasingly leading causing viral resistance (see, e.g., Adams et al., (2010) *Clin Infect Dis.* 51(2):185-188).

Generally, the anti-RSV antibodies provided herein bind to RSV F protein with high affinity. Compared to existing approved anti-RSV antibodies (e.g. palivizumab; Synagis), the high affinity anti-RSV antibodies provided herein allow for less frequent administration for preventing and/or treating a RSV infection, for preventing, treating, and/or alleviating one or more symptoms of a RSV infection, or for reducing the duration of a RSV infection. Thus, the anti-RSV antibodies provided herein are useful as therapeutic antibodies, i.e., for treatment of RSV infection. Less frequent administration allows easier compliance with dosing regimes and therefore lessens the possibility of missed dosages which lead to increased viral resistance to the anti-RSV antibody. Lower doses of antibodies that immunospecifically bind to RSV also can reduce the likelihood of adverse effects of immunoglobulin therapy.

Generally, the anti-RSV antibodies provided herein have the ability to inhibit or reduce one or more activities of the virus, such as, for example, association of the virus with a target cell membrane, fusion of the virus with the target cell membrane and/or cell entry, production of new viral particles, including inhibition of viral replication, or cell to cell fusion of an infected cell with another cell (i.e. syncytia formation). The provided anti-RSV antibodies also can be employed to increase the immune the response against a RSV infection.

1. Respiratory Syncytial Virus

Human RSV is a member of the Pneumovirus subfamily of the family Paramyxoviridae. There are two distinct subgroups of human RSV, group A and group B. Additionally, each subtype is further divided into two strains, A1 and A2, and B1 and B2. RSV is an enveloped, non-segmented, negative-sense RNA virus with a genome of composed of approximately 15,000 nucleotides that encode eleven viral proteins.

RSV encodes two major surface glycoproteins, glycoprotein G and glycoprotein F. Glycoprotein G, or the attachment protein, mediates virus binding to the cell receptor while glycoprotein F, or the fusion protein, promotes fusion of the viral and cell membranes, allowing penetration of the viral ribonucleoprotein into the cell cytoplasm (Lopez et al. (1998) *J. Virology* 72:6922-6928). Glycoprotein F also promotes fusion of the membranes of infected cells with those of adjacent cells leading to the formation of syncytia. The F protein contains two disulfide-linked subunits, $F_1$ and $F_2$, which are produced by proteolytic cleavage of an inactive, N-glycosylated precursor. The G protein is a 80-90 kDa type II transmembrane glycoprotein, containing N- and O-linked oligosaccharides attached to a 32 kDa precursor protein.

Antibodies prepared against RSV F or G glycoproteins have been shown to neutralize RSV with high efficiency in vitro and have prophylactic effects in vivo (see e.g., Walsh et al. (1986) *J. Gen. Microbiol.* 67:505; Beeler et al. (1989) *J. Virol.* 63:2941-2950, Garcia-Borreno et al. (1989) *J. Virol.* 63:925-932, Taylor et al. (1984) *Immunology* 52:137-142, and U.S. Pat. Nos. 5,842,307 and 6,818,216). Antibodies directed against RSV F protein also are effective in inhibiting fusion of RSV-infected cells with neighboring uninfected cells.

Analysis of various monoclonal antibodies that immunospecifically bind to the RSV F protein have led to the identification of three non-overlapping antigenic sites, A, B, and C and one bridge site, AB (Beeler et al. (1989) *J. Virol.* 63:2941-2950). Each of the antigenic sites contain distinct epitopes. In one study of a panel of 18 monoclonal antibodies, five epitopes of antigenic site A, four epitopes of antigenic site B, and four epitopes of antigenic site C were identified based on monoclonal antibody escape mutants (MARMs) (see, e.g., Beeler et al. (1989) *J. Virol.* 63:2941-2950). The RSV A2 strain F protein mutations effecting escape of these anti-RSV antibodies, include single amino acid mutations at amino acid residues N262, K272, S275, N276, P389 or R429, or double amino acid mutations at F32 and K272 or A241 and K421 (see, e.g., Crowe et al. (1998) *Virology* 252:373-375; Zhao et al., (2004) *J. Infectious Disease* 190:1941-1946 and Liu et al., (2007) *Virology Journal* 4:71). Monoclonal antibody 1129, which binds to antigenic site A epitope 4 (Beeler et al. (1989) *J. Virology* 63(7):2841-2950), is the parental antibody from which the humanized palivizumab (SYNAGIS®) was generated (see Johnson et al. (1997) *J. Infect. Diseases* 176:1215-1224 and U.S. Pat. No. 5,824,307). Single amino acid mutations at residues N262, N268 or K272 of the RSV F protein have been previously shown to effect escape from palivizumab (SYNAGIS®) (see, Zhao et al., (2004) *J. Infectious Disease* 190:1941-1946). Additional RSV F protein epitopes also have been identified. For example, the human anti-RSV Fab fragment Fab 19 (see Barbas et al. (1992) *Proc. Natl. Acad. Sci. USA* 89:10164-10168 and Crowe et al., (1994) *Proc. Natl. Acad Sci USA* 91:1386-1390) binds to an epitope in antigenic site A that differs from the epitopes identified by Beeler et al. (see Crowe et al. (1998) *Virology* 252:373-375) and Barbas et al. (1992) *Proc. Natl. Acad. Sci. USA* 89:10164-10168).

The RSV F protein exhibits over 91% similarity across the RSV A and B subgroups, while the RSV G protein exhibit only 53% amino acid similarity between the RSV A and RSV B subgroups (Sullender (2000) *Clin. Microbiol. Rev.* 13:1-15). Because A and B virus subtypes co-circulate in most RSV epidemics, an antibody that neutralizes A and B subtypes of RSV, such as the anti-RSV antibodies or antigen-binding fragments provided herein, is desirable.

Respiratory syncytial virus (RSV) infection is a major cause of lower respiratory tract disease in infants and small children. RSV infection also is the most common cause of bronchiolitis, or inflammation of the small airways in the lung, and pneumonia in children under 1 year of age in the United States. In addition, RSV infection also is recognized as an important cause of respiratory illness in older adults. Symptoms and conditions associated with RSV infection include, for example, asthma, wheezing, reactive airway disease (RAD), and chronic obstructive pulmonary disease (COPD). Accordingly, as described herein, the anti-RSV antibodies provided herein can be employed for the prophylaxis of RSV, for treatment of RSV infection and/or for alleviation of one or more symptoms of such RSV-mediated diseases.

C. ANTI-RSV ANTIBODIES

Provided herein are anti-RSV antibodies or antigen-binding fragments thereof that can be employed for therapeutic, prophylactic and diagnostic use. The anti-RSV antibodies or antigen-binding fragments thereof provided herein can be used, for example, for passive immunization of a subject against RSV or for treatment of a subject with a viral infection. In one example, the anti-RSV antibodies or antigen-binding fragments thereof provided herein are used for prophylaxis, i.e., the prevention of RSV infection. In another example, the anti-RSV antibodies or antigen-binding fragments thereof provided herein are used as therapeutic antibodies, i.e., for treatment of a RSV viral infection. In yet another example, the anti-RSV antibodies or antigen-binding fragments thereof provided herein are used for passive immunization of a subject against RSV. The provided anti-RSV antibodies or antigen-binding fragments thereof also can be used for detection of a RSV infection or for monitoring RSV infection in vitro and in vivo.

1. General Antibody Structure and Functional Domains

Antibodies are produced naturally by B cells in membrane-bound and secreted forms. Antibodies specifically recognize and bind antigen epitopes through cognate interactions. Antibody binding to cognate antigens can initiate multiple effector functions, which cause neutralization and clearance of toxins, pathogens and other infectious agents.

Diversity in antibody specificity arises naturally due to recombination events during B cell development. Through these events, various combinations of multiple antibody V, D and J gene segments, which encode variable regions of antibody molecules, are joined with constant region genes to generate a natural antibody repertoire with large numbers of diverse antibodies. A human antibody repertoire contains more than $10^{10}$ different antigen specificities and thus theoretically can specifically recognize any foreign antigen. Antibodies include such naturally produced antibodies, as well as synthetically, i.e. recombinantly, produced antibodies, such as antibody fragments, including the anti-RSV antibodies or antigen-binding fragments thereof provided herein.

In folded antibody polypeptides, binding specificity is conferred by antigen-binding site domains, which contain portions of heavy and/or light chain variable region domains. Other domains on the antibody molecule serve effector functions by participating in events such as signal transduction and interaction with other cells, polypeptides and biomolecules. These effector functions cause neutralization and/or clearance of the infecting agent recognized by the antibody. Domains of antibody polypeptides can be varied according to the methods herein to alter specific properties.

a. Structural and Functional Domains of Antibodies

Full-length antibodies contain multiple chains, domains and regions. A full length conventional antibody contains two heavy chains and two light chains, each of which contains a plurality of immunoglobulin (Ig) domains. An Ig domain is characterized by a structure called the Ig fold, which contains two beta-pleated sheets, each containing anti-parallel beta strands connected by loops. The two beta sheets in the Ig fold are sandwiched together by hydrophobic interactions and a conserved intra-chain disulfide bond. The Ig domains in the antibody chains are variable (V) and constant (C) region domains. Each heavy chain is linked to a light chain by a disulfide bond, and the two heavy chains are linked to each other by disulfide bonds. Linkage of the heavy chains is mediated by a flexible region of the heavy chain, known as the hinge region.

Each full-length conventional antibody light chain contains one variable region domain ($V_L$) and one constant region domain ($C_L$). Each full-length conventional heavy chain contains one variable region domain ($V_H$) and three or four constant region domains ($C_H$) and, in some cases, hinge region. Owing to recombination events discussed above, nucleic acid sequences encoding the variable region domains differ among antibodies and confer antigen-specificity to a particular antibody. The constant regions, on the other hand, are encoded by sequences that are more conserved among antibodies. These domains confer functional properties to antibodies, for example, the ability to interact with cells of the immune system and serum proteins in order to cause clearance of infectious agents. Different classes of antibodies, for example IgM, IgD, IgG, IgE and IgA, have different constant regions, allowing them to serve distinct effector functions.

Each variable region domain contains three portions called complementarity determining regions (CDRs) or hypervariable (HV) regions, which are encoded by highly variable nucleic acid sequences. The CDRs are located within the loops connecting the beta sheets of the variable region Ig domain. Together, the three heavy chain CDRs (CDR1, CDR2 and CDR3) and three light chain CDRs (CDR1, CDR2 and CDR3) make up a conventional antigen-binding site (antibody combining site) of the antibody, which physically interacts with cognate antigen and provides the specificity of the antibody. A whole antibody contains two identical antibody combining sites, each made up of CDRs from one heavy and one light chain. Because they are contained within the loops connecting the beta strands, the three CDRs are non-contiguous along the linear amino acid sequence of the variable region. Upon folding of the antibody polypeptide, the CDR loops are in close proximity, making up the antigen combining site. The beta sheets of the variable region domains form the framework regions (FRs), which contain more conserved sequences that are important for other properties of the antibody, for example, stability.

b. Antibody Fragments

Antibodies provided herein include antibody fragments, which are derivatives of full-length antibody that contain less than the full sequence of the full-length antibodies but retain at least a portion specific binding abilities of the full-length antibody. The antibody fragments also can include antigen-binding portions of an antibody that can be inserted into an antibody framework (e.g., chimeric antibodies) in order to retain the binding affinity of the parent antibody. Examples of antibody fragments include, but are not limited to, Fab, Fab', $F(ab')_2$, single-chain Fv (scFv), Fv, dsFv, diabody, Fd and Fd' fragments, and other fragments, including modified fragments (see, for example, Methods in Molecular Biology, Vol 207: Recombinant Antibodies for Cancer Therapy Methods and Protocols (2003); Chapter 1; p 3-25, Kipriyanov). Antibody fragments can include multiple chains linked together, such as by disulfide bridges and can be produced recombinantly. Antibody fragments also can contain synthetic linkers, such as peptide linkers, to link two or more domains. Methods for generating antigen-binding fragments are well-known in the art and can be used to modify any antibody provided herein. Fragments of antibody molecules can be generated, such as for example, by enzymatic cleavage. For example, upon protease cleavage by papain, a dimer of the heavy chain constant regions, the Fc domain, is cleaved from the two Fab regions (i.e. the portions containing the variable regions).

Single chain antibodies can be recombinantly engineered by joining a heavy chain variable region ($V_H$) and light chain variable region ($V_L$) of a specific antibody. The particular nucleic acid sequences for the variable regions can be cloned by standard molecular biology methods, such as, for example, by polymerase chain reaction (PCR) and other recombination nucleic acid technologies. Methods for producing sFvs are described, for example, by Whitlow and Filpula (1991) *Methods,* 2: 97-105; Bird et al. (1988) *Science* 242:423-426; Pack et al. (1993) Bio/Technology 11:1271-77; and U.S. Pat. Nos. 4,946,778, 5,840,300, 5,667,988, 5,658,727, 5,258,498). Single chain antibodies also can be identified by screening single chain antibody libraries for binding to a target antigen. Methods for the construction and screening of such libraries are well-known in the art.

2. Exemplary Anti-RSV Antibodies

Provided herein are antibodies or antigen-binding fragments thereof that bind to and neutralize RSV. In particular the antibodies or antigen-binding fragments immunospecifically bind to a RSV F protein.

The anti-RSV antibodies or antigen-binding fragments thereof provided herein include monoclonal antibodies, multispecific antibodies, bispecific antibodies, human antibodies, humanized antibodies, camelised antibodies, chimeric antibodies, single-chain Fvs (scFv), single chain antibodies, single domain antibodies, Fab fragments, F(ab') fragments, disulfide-linked Fvs (sdFv), and anti-idiotypic (anti-Id) antibodies, intrabodies, or antigen-binding fragments of any of the above. In particular, antibodies include immunoglobulin molecules and immunologically active fragments of immunoglobulin molecules, i.e., molecules that contain an antigen-binding site. Immunoglobulin molecules can be of any type (e.g., IgG, IgE, IgM, IgD, IgA and IgY), class (e.g., IgG1, IgG2, IgG3, IgG4, IgA1 and IgA2) or subclass.

The anti-RSV antibodies or antigen-binding fragments thereof provided herein can be used in the methods of treatment and diagnosis in forms that include monoclonal antibodies, multispecific antibodies, human antibodies, humanized antibodies, camelised antibodies, chimeric antibodies, single-chain Fvs (scFv), single chain antibodies, single domain antibodies, Fab fragments, F(ab') fragments, disulfide-linked Fvs (sdFv), and anti-idiotypic (anti-Id) antibodies, intrabodies, or antigen-binding fragments of any of the above. In particular, the antibodies include immunoglobulin molecules and immunologically active fragments of immunoglobulin molecules, i.e., molecules that contain an antigen-binding site. Immunoglobulin molecules can be of any type (e.g., IgG, IgE, IgM, IgD, IgA and IgY), class (e.g., IgG1, IgG2, IgG3, IgG4, IgA1 and IgA2) or subclass.

Exemplary anti-RSV antibodies or antigen-binding fragments thereof provided herein that immunospecifically bind to a RSV F protein include 58c5 and sc5, which are Fab fragments described in detail elsewhere herein. Exemplary anti-RSV antibodies or antigen-binding fragments thereof provided herein also include anti-RSV antibodies or antigen-binding fragments thereof that contain a heavy chain, which contains a variable heavy ($V_H$) domain and a constant heavy domain 1 ($C_H1$) and/or a light chain, which contains a variable light ($V_L$) domain and a constant light domain ($C_L$) of 58c5 or sc5. For example, exemplary anti-RSV antibodies or antigen-binding fragments thereof provided herein include anti-RSV antibodies or antigen-binding fragments thereof that contain a heavy chain having the amino acid sequence set forth in SEQ ID NO:1 or 9 and/or a light chain having the amino acid sequence set forth in SEQ ID NO:5 or 13. In a particular example, the anti-RSV antibody is a Fab fragment that contains a heavy chain having the amino acid sequence set forth in SEQ ID NO:1 and a light chain having the amino acid sequence set forth in SEQ ID NO:5. In a particular example, the anti-RSV antibody is a Fab fragment that contains a heavy chain having the amino acid sequence set forth in SEQ ID NO: 9 and a light chain having the amino acid sequence set forth in SEQ ID NO:13.

The antibodies provided herein include full-length antibody forms of 58c5 or sc5. The antibodies provided herein also include full-length antibody forms containing the antigen-binding site (e.g. CDRs) of 58c5 or sc5. The anti-RSV antibodies or antigen-binding fragments thereof provided herein can contain any constant region known in the art, such as any human constant region known in the art, including, but not limited to, human light chain kappa (κ), human light chain lambda (λ), the constant region of IgG1, the constant region of IgG2, the constant region of IgG3 or the constant region of IgG4. The antibodies or antigen-binding fragments provided herein can contain any constant region that is known in the art. In some examples, one or more constant regions of the antibody are human.

The antibodies provided herein include other antibody fragment forms of 58c5 and sc5 that immunospecifically bind an RSV F protein. Such fragments include any antigen-binding fragment thereof or an engineered antibody containing an antigen-binding fragment(s) of 58c5 or sc5 that retains the ability to bind an RSV F protein. Such antibodies include, for example, chimeric antibodies, single-chain Fvs (scFv), single chain antibodies, single domain antibodies, F(ab') fragments, disulfide-linked Fvs (sdFv), anti-idiotypic (anti-Id) antibodies, intrabodies, or antigen-binding fragments of any of the above. In particular examples, the antibody is the a Fab fragment 58c5 or sc5.

Exemplary anti-RSV antibodies or antigen-binding fragments thereof provided herein include anti-RSV antibodies or antigen-binding fragments thereof that contain a $V_H$ domain and/or a variable light $V_L$ domain having an amino acid sequence of the $V_H$ domain and/or $V_L$ domain, respectively, of 58c5 or sc5. For example, an antibody or antigen-binding fragment thereof can contain a $V_H$ domain having the amino acid sequence set forth in amino acids 1-125 of SEQ ID NO: 1 or 9 and/or a $V_L$ domain having the amino acid sequence set forth in amino acids 1-107 of SEQ ID NO: 5 or 13. In one example, an antibody or antigen-binding fragment thereof contains a $V_H$ domain having the amino acid sequence set forth in amino acids 1-125 of SEQ ID NO: 1 and a $V_L$ domain having the amino acid sequence set forth in amino acids 1-107 of SEQ ID NO: 5. In another example, an antibody or antigen-binding fragment thereof contains a $V_H$ domain having the amino acid sequence set forth in amino acids 1-125 of SEQ ID NO: 9 and a $V_L$ domain having the amino acid sequence set forth in amino acids 1-107 of SEQ ID NO: 13.

Exemplary anti-RSV antibodies or antigen-binding fragments thereof provided herein include anti-RSV antibodies or antigen-binding fragments thereof that contain a $V_H$ domain and/or a $V_L$ domain having an amino acid sequence that is at least or about 80% identical to the $V_H$ domain and/or $V_L$ domain, respectively, of 58c5 or sc5. For example, the antibody or antigen-binding fragment thereof provided herein can contain a $V_H$ domain having the amino acid sequence that is 80% identical to the amino acid sequence set forth in amino acids 1-125 of SEQ ID NO: 1 or 9 and/or a $V_L$ domain having the amino acid sequence that is 80% identical to the amino acid sequence set forth in amino acids 1-107 of SEQ ID NO: 5 or 13.

In some examples, the anti-RSV antibody or antigen-binding fragment thereof provided herein can contain a $V_H$ domain having the amino acid sequence that is at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, at least or about 98%, or at least or about 99% identical to the amino acid sequence set forth in amino acids 1-125 of SEQ ID NO: 1 or 9 and/or a $V_L$ domain having the amino acid sequence that is at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, at least or about 98%, or at least or about 99% identical to the amino acid sequence set forth in amino acids 1-107 of SEQ ID NO: 5 or 13.

Thus, provided herein is an antibody or antigen-binding fragment thereof that contains a $V_H$ domain having an amino acid sequence that is at least or that is about 80% to 99% identical, for example, 90% to 99% or at least 95% identical, such as 81%, 82%, 83%, 84%, 85%, 86%, 87%, 88%, 89%, 90%, 91%, 92%, 93%, 94%, 95%, 96%, 97%, 98% or 99% identical to the amino acid sequence set forth in amino acids 1-125 of SEQ ID NO: 1 and that contains a $V_L$ domain having the amino acid sequence that is at least or that is about 80% to 99% identical, for example, 90% to 99% or at least 95% identical, such as 81%, 82%, 83%, 84%, 85%, 86%, 87%, 88%, 89%, 90%, 91%, 92%, 93%, 94%, 95%, 96%, 97%, 98% or 99% identical to the amino acid sequence set forth in amino acids 1-107 of SEQ ID NO: 5.

In another example, provided herein is an antibody or antigen-binding fragment thereof that contains a $V_H$ domain having an amino acid sequence that is at least or that is about 80% to 99% identical, for example, 90% to 99% or at least 95% identical, such as 81%, 82%, 83%, 84%, 85%, 86%, 87%, 88%, 89%, 90%, 91%, 92%, 93%, 94%, 95%, 96%, 97%, 98% or 99% identical to the amino acid sequence set forth in amino acids 1-125 of SEQ ID NO: 9 and that contains a $V_L$ domain having the amino acid sequence that is at least or that is about 80% to 99% identical, for example, 90% to 99% or at least 95% identical, such as 81%, 82%, 83%, 84%, 85%, 86%, 87%, 88%, 89%, 90%, 91%, 92%, 93%, 94%, 95%, 96%, 97%, 98% or 99% identical to the amino acid sequence set forth in amino acids 1-107 of SEQ ID NO: 13.

Also provided are anti-RSV antibodies or antigen-binding fragments thereof that contain one or more $V_H$ complementarity determining regions (CDRs) selected from among the CDRs of 58c5 or sc5. For example, the anti-RSV antibody or antigen-binding fragment thereof can contain a $V_H$ CDR1 having the amino acid sequence set forth in SEQ ID NO:2, 1627, 10 or 1628. For example, the anti-RSV antibody or antigen-binding fragment thereof can contain a $V_H$ CDR1 having the amino acid sequence GASINSDNYYWT (SEQ ID NO:2), SDNYYWT (SEQ ID NO:1627), GDSISGSNWWN (SEQ ID NO:10) or GSNWWN (SEQ ID NO:1628).

In another example, the anti-RSV antibody or antigen-binding fragment thereof can contain a $V_H$ CDR2 having the amino acid sequence set forth in SEQ ID NO:3 or 11. For example, the anti-RSV antibody or antigen-binding fragment thereof can contain a $V_H$ CDR2 having the amino acid sequence HISYTGNTYYTPSLKS (SEQ ID NO:3) or EIYYRGTTNYKSSLKG (SEQ ID NO:11).

In another example, the anti-RSV antibody or antigen-binding fragment thereof can contain a $V_H$ CDR3 having the amino acid sequence set forth in SEQ ID NO:4 or 12. For example, the anti-RSV antibody or antigen-binding fragment thereof can contain a $V_H$ CDR3 having the amino acid sequence CGAYVLISNCGWFDS (SEQ ID NO:4) or GGRSTFGPDYYYYMDV (SEQ ID NO:12).

In one particular example, the anti-RSV antibody or antigen-binding fragment thereof contains a $V_H$ CDR1 having the amino acid sequence set forth in SEQ ID NO:2, a $V_H$ CDR2 having the amino acid sequence set forth in SEQ ID NO:3, and a $V_H$ CDR3 having the amino acid sequence set forth in SEQ ID NO:4.

In another particular example, the anti-RSV antibody or antigen-binding fragment thereof contains a $V_H$ CDR1 having the amino acid sequence set forth in SEQ ID NO:10, a $V_H$ CDR2 having the amino acid sequence set forth in SEQ ID NO:11, and a $V_H$ CDR3 having the amino acid sequence set forth in SEQ ID NO:12.

Also provided are anti-RSV antibodies or antigen-binding fragments thereof that contain one or more $V_L$ complementarity determining regions (CDRs) selected from among the CDRs of 58c5 or sc5. For example, the anti-RSV antibody or antigen-binding fragment thereof can contain a $V_L$ CDR1 having the amino acid sequence set forth in SEQ ID NO:6 or 14. For example, the anti-RSV antibody or antigen-binding fragment thereof can contain a $V_L$ CDR1 having the amino acid sequence QASQDISTYLN (SEQ ID NO:6) or RASQNIKNYLN (SEQ ID NO:14).

In another example, the anti-RSV antibody or antigen-binding fragment thereof can contain a $V_L$ CDR2 having the amino acid sequence set forth in SEQ ID NO:7 or 15. For example, the anti-RSV antibody or antigen-binding fragment thereof can contain a $V_L$ CDR2 having the amino acid sequence GASNLET (SEQ ID NO:7) or AASTLQS (SEQ ID NO:15).

In another example, the anti-RSV antibody or antigen-binding fragment thereof can contain a $V_L$ CDR3 having the amino acid sequence set forth in SEQ ID NO:8 or 16. For example, the anti-RSV antibody or antigen-binding fragment thereof can contain a $V_L$ CDR3 having the amino acid sequence QQYQYLPYT (SEQ ID NO:8) or QQSYNNQLT (SEQ ID NO:16).

In one particular example, the anti-RSV antibody or antigen-binding fragment thereof containss a $V_L$ CDR1 having the amino acid sequence set forth in SEQ ID NO:6, a $V_L$ CDR2 having the amino acid sequence set forth in SEQ ID NO:7, and a $V_L$ CDR3 having the amino acid sequence set forth in SEQ ID NO:8.

In another particular example, the anti-RSV antibody or antigen-binding fragment thereof contains a $V_L$ CDR1 having the amino acid sequence set forth in SEQ ID NO:14, a $V_L$ CDR2 having the amino acid sequence set forth in SEQ ID NO:15, and a $V_L$ CDR3 having the amino acid sequence set forth in SEQ ID NO:16.

Any combination of CDRs provided herein can be selected for the generation of an antibody or antigen-binding fragment thereof, provided that the antibody or antigen-binding fragment retains the ability to immunospecifically bind to a RSV F protein. The anti-RSV antibodies or antigen-binding fragments thereof can contain an antibody framework region known in the art. Exemplary framework regions include isolated naturally occurring or consensus framework regions, including human framework regions (see, e.g., Chothia et al. (1998) *J. Mol. Biol.* 278: 457-479). In some examples, the antibody framework region is a human antibody framework region. In some examples, the or antigen-binding fragment contains a framework region of 58c5 or sc5.

Exemplary isolated anti-RSV antibodies or antigen-binding fragments thereof provided herein include any anti-RSV antibody or antigen-binding fragments thereof that immunospecifically binds to the same epitope on a Respiratory Syncytial Virus (RSV) fusion (F) protein as any of the antibodies provided herein. In one example, provided herein is an antibody that binds to the same epitope as 58c5, which is the antibody that contains a heavy chain set forth in SEQ ID NO:1 and a light chain set forth in SEQ ID NO:5. In another example, provided herein is an antibody that binds to the same epitope as sc5, which is the antibody that contains a heavy chain set forth in SEQ ID NO:9 and a light chain set forth in SEQ ID NO:13. Typically, such antibodies contain a variable heavy ($V_H$) chain and a variable light ($V_L$) chain or antigen-binding fragments thereof.

The antibodies or antigen binding fragments provided herein exhibit a binding affinity constant ($K_a$) for the RSV F protein epitope of at least or about $1\times10^8$ $M^{-1}$, at least or about $2.5\times10^8$ $M^{-1}$, at least or about $5\times10^8$ $M^{-1}$, at least or about $1\times10^9$ $M^{-1}$, at least or about $5\times10^9$ $M^{-1}$, at least or about $1\times10^{10}$ $M^{-1}$, at least or about $5\times10^{10}$ $M^{-1}$, at least or about $1\times10^{11}$ $M^{-1}$, at least or about $5\times10^{11}$ $M^{-1}$, at least or about $1\times10^{12}$ $M^{-1}$, at least or about $5\times10^{12}$ $M^{-1}$, at least or about $1\times10^{13}$ $M^{-1}$, at least or about $5\times10^{13}$ $M^{-1}$, at least or about $1\times10^{14}$ $M^{-1}$, at least or about $5\times10^{14}$ $M^{-1}$, at least or about $1\times10^{15}$ $M^{-1}$, or at least or about $5\times10^{15}$ $M^{-1}$. The antibodies provided herein can exhibit a binding affinity for a recombinantly purified F protein, such as the extracellular domain of RSV A2 strain F protein set forth in SEQ ID NO:25. The antibodies provided herein also can exhibit a binding affinity for native RSV F protein, such as is generated by infection and expression of RSV in cells. The antibodies provided herein can have binding affinities that are the same or different for recombinantly purified F protein versus native RSV F protein. For example, Example 4 shows that 58c5 has a higher binding affinity for native RSV F protein than for recombinantly purified F protein. In contrast, sc5 exhibits similar binding affinity whether the RSV F protein is native or is recombinantly expressed.

In some examples, the antibodies or antigen binding fragments provided herein have a dissociation constant ($K_d$) for the RSV F protein epitope of less than or about $1\times10^{-8}$ M, less than or about $4\times10^{-9}$ M, less than or about $2\times10^{-9}$ M, less than or about $1\times10^{-9}$ M, less than or about $2\times10^{-10}$ M, less than or about $1\times10^{-10}$ M, less than or about $2\times10^{-11}$ M, less than or about $1\times10^{-11}$ M, less than or about $2\times10^{-12}$ M, less than or about $1\times10^{-12}$ M, less than or about $2\times10^{-13}$ M, less than or about $1\times10^{-13}$ M, less than or about $2\times10^{-14}$ M, less than or about $1\times10^{-14}$ M, less than or about $2\times10^{-15}$ M, less than or about $1\times10^{-15}$ M, or less than or about $2\times10^{-16}$ M.

In some examples, the antibodies or antigen-binding fragments provided herein have $EC_{50}$ of less than or about 0.005 nM, less than or about 0.01 nM, less than or about 0.025 nM, less than or about 0.05 nM, less than or about 0.075 nM, less than or about 0.1 nM, less than or about 0.5 nM, less than or about 0.75 nM, less than or about 1 nM, less than or about less than or about 1.25 nM, less than or about 1.5 nM, less than or about 1.75 nM, less than or about 2 nM in an in vitro microneutralization assay for neutralization of RSV. In particular examples, the isolated anti-RSV antibodies or antigen-binding fragments provided herein have an $EC_{50}$ for neutralization of RSV in an in vitro plaque reduction assay of less than or about 0.005 nM to less than or about 2 nM; less than or about 0.005 nM to less than or about 1 nM; less than or about 0.005 nM to less than or about 0.5 nM; less than or about 0.01 nM to less than or about 1 nM; less than or about 0.05 nM to less than or about 1 nM; less than or about 0.05 nM to less than or about 0.5 nM; or less than or about 0.1 nM to less than or about 0.5 nM.

In some examples, an anti-RSV antibody or antigen-binding fragment thereof provided herein neutralizes monoclonal antibody escape mutants (MARMs) against various anti-RSV antibodies in an in vitro microneutralization assay for neutralization of RSV. In a particular example, an anti-RSV antibody or antigen-binding fragment thereof provided herein neutralizes a MARM with an $EC_{50}$ for neutralization of that is or is about the same as the $EC_{50}$ for neutralization of a parental RSV strain from which the MARM was generated. If a first antibody can neutralize a MARM generated against a second antibody, one can conclude that the antibodies specifically bind to or interact with different epitopes.

In some examples, an anti-RSV antibody or antigen-binding fragment thereof provided herein inhibits the binding of RSV to its host cell receptor by at least or about 99%, at least or about 95%, at least or about 90%, at least or about 85%, at least or about 80%, at least or about 75%, at least or about 70%, at least or about 65%, at least or about 60%, at least or about 55%, at least or about 50%, at least or about 45%, at least or about 40%, at least or about 35%, at least or about 30%, at least or about 25%, at least or about 20%, at least or about 15%, or at least or about 10% relative to the binding of RSV to its host cell receptor in the absence of the anti-RSV antibody or antigen-binding fragment thereof. In some examples, an anti-RSV antibody or antigen-binding fragment provided herein inhibits RSV replication by at least or about 99%, at least or about 95%, at least or about 90%, at least or about 85%, at least or about 80%, at least or about 75%, at least or about 70%, at least or about 65%, at least or about 60%, at least or about 55%, at least or about 50%, at least or about 45%, at least or about 40%, at least or about 35%, at least or about 30%, at least or about 25%, at least or about 20%, at least or about 15%, or at least or about 10% relative to RSV replication in the absence of the anti-RSV antibody or antigen-binding fragment thereof.

In some examples the antibodies or antigen-binding fragments thereof provided herein have a half-life of 15 days or longer, 20 days or longer, 25 days or longer, 30 days or longer, 40 days or longer, 45 days or longer, 50 days or longer, 55 days or longer, 60 days or longer, 3 months or longer, 4 months or longer or 5 months or longer. Methods to increase the half-life of an antibody or antigen-binding fragment thereof provided herein are known in the art. Such methods include for example, pegylation, glycosylation, and amino acid substitution as described elsewhere herein.

a. Derivative Antibodies

The anti-RSV antibodies or antigen-binding fragments thereof provided herein can be used to generate derivative antibodies such as a chimeric antibodies or other antigen-binding fragments, such as for example, Fab, Fab', $F(ab')_2$, single-chain Fv (scFv), Fv, dsFv, diabody, Fd and Fd' fragments. Generally, the derivative antibody or antigen-binding fragment derived from a parent antibody retains the binding specificity of the parent antibody. Antibody fragments can be generated by any techniques known to those of skill in the art. For example, Fab and $F(ab')_2$ fragments can be produced by proteolytic cleavage of immunoglobulin molecules, using enzymes such as papain (to produce Fab fragments) or pepsin (to produce $F(ab')_2$ fragments). $F(ab')_2$ fragments contain the variable region, the light chain constant region and the $C_H1$ domain of the heavy chain. Further, anti-RSV antibodies or antigen-binding fragments thereof provided herein also can be generated using various phage display methods known in the art. In some examples, the antigen-binding variable regions of the anti-RSV antibodies or antigen-binding fragments thereof provided herein can be recombinantly fused to one or more constant regions known in the art to generate chimeric full length antibodies, Fab, Fab', $F(ab')_2$ or other antigen-binding fragments. Exemplary methods for generating full length antibodies from antibody fragments are known in the art and provided herein. Methods for producing chimeric antibodies are known in the art (see e.g., Morrison (1985) *Science* 229:1202; Oi et al. (1986) *BioTechniques* 4:214; Gillies et al. (1989) *J. Immunol. Methods* 125:191-202; and U.S. Pat. Nos. 5,807,715, 4,816,567, and 4,816,397).

Chimeric antibodies comprising one or more CDRs from an anti-RSV antibody provided herein and framework regions from a heterologous immunoglobulin molecule can be produced using a variety of techniques known in the art including, for example, CDR-grafting (EP 239,400; PCT publication No. WO 91/09967; and U.S. Pat. Nos. 5,225,539, 5,530,101, and 5,585,089), veneering or resurfacing (EP 592,106; EP 519,596; Padlan (1991) *Molecular Immunology* 28(4/5):489-498; Studnicka et al. (1994) *Protein Engineering* 7(6):805-814; and Roguska et al. (1994) *PNAS* 91:969-973), and chain shuffling (U.S. Pat. No. 5,565,332).

In some examples, antibodies contain one or more CDRs of 58c5 (e.g., one or more CDRs set forth in SEQ ID NOS: 2-4, 1627 and 6-8) and a heterologous framework region. In some examples, antibodies contain one or more CDRs of sc5 (e.g., one or more CDRs set forth in SEQ ID NOS: 10-12, 1628 and 14-16) and a heterologous framework region. Framework residues in the framework regions can be substituted with the corresponding residue from the CDR donor antibody to alter, such as improve, antigen-binding. These framework substitutions are identified by methods well known in the art, e.g., by modeling of the interactions of the CDR and framework residues to identify framework is residues important for antigen-binding and sequence comparison to identify unusual framework residues at particular positions (see, e.g., U.S. Pat. No. 5,585,089; and Riechmann et al. (1988) *Nature* 332:323).

In some examples, the derivative anti-RSV antibodies or antigen-binding fragments thereof have a binding affinity constant ($K_a$) for the RSV F protein epitope of at least or about $1\times10^8$ $M^{-1}$, at least or about $2.5\times10^8$ $M^{-1}$, at least or about $5\times10^8$ $M^{-1}$, at least or about $1\times10^9$ $M^{-1}$, at least or about $5\times10^9$ $M^{-1}$, at least or about $1\times10^{10}$ $M^{-1}$, at least or about $5\times10^{10}$ $M^{-1}$, at least or about $1\times10^{11}$ $M^{-1}$, at least or about $5\times10^{11}$ $M^{-1}$, at least or about $1\times10^{12}$ $M^{-1}$, at least or about $5\times10^{12}$ $M^{-1}$, at least or about $1\times10^{13}$ $M^{-1}$, at least or about $5\times10^{13}$ $M^{-1}$, at least or about $1\times10^{14}$ $M^{-1}$, at least or about $5\times10^{14}$ $M^{-1}$, at least or about $1\times10^{15}$ $M^{-1}$, or at least or about $5\times10^{15}$ $M^{-1}$.

In some examples, the derivative anti-RSV antibodies or antigen-binding fragments thereof have a dissociation constant ($K_d$) for the RSV F protein epitope of less than or about $1\times10^{-8}$ M, less than or about $4\times10^{-9}$ M, less than or about $2\times10^{-9}$ M, less than or about $1\times10^{-9}$ M, less than or about $2\times10^{-10}$ M, less than or about $1\times10^{-10}$ M, less than or about $2\times10^{-11}$ M, less than or about $1\times10^{-11}$ M, less than or about $2\times10^{-12}$ M, less than or about $1\times10^{-12}$ M, less than or about $2\times10^{-13}$ M, less than or about $1\times10^{-13}$ M, less than or about $2\times10^{-14}$ M, less than or about $1\times10^{-14}$ M, less than or about $2\times10^{-15}$ M, less than or about $1\times10^{-15}$ M, or less than or about $2\times10^{-16}$ M.

In some examples, the derivative anti-RSV antibodies or antigen-binding fragments thereof have $EC_{50}$ of less than or about 0.005 nM, less than or about 0.01 nM, less than or about 0.025 nM, less than or about 0.05 nM, less than or about 0.075 nM, less than or about 0.1 nM, less than or about 0.5 nM, less than or about 0.75 nM, less than or about 1 nM, less than or about 1.25 nM, less than or about 1.5 nM, less than or about 1.75 nM, or less than or about 2 nM in an in vitro microneutralization assay for neutralization of RSV. In particular examples, the derivative anti-RSV antibodies or antigen-binding fragments thereof have an $EC_{50}$ for neutralization of RSV in an in vitro plaque reduction assay of less than or about 0.005 nM to less than or about 2 nM; less than or about 0.005 nM to less than or about 1 nM; less than or about 0.005 nM to less than or about 0.5 nM; less than or about 0.01 nM to less than or about 1 nM; less than or about 0.05 nM to less than or about 1 nM; less than or about 0.05 nM to less than or about 0.5 nM; or less than or about 0.1 nM to less than or about 0.5 nM.

Any derivative of an anti-RSV antibody or antigen-binding fragment thereof provided herein can be used in therapeutic regimens, prophylaxis therapies and/or diagnostic techniques, such as in the methods provided. For example, the derivative antibodies or antigen-binding fragments thereof can be used to bind to RSV for the treatment, prevention and/or detection of RSV infection or alleviation of one or more symptoms of a RSV infection.

i. Single Chain Antibodies

In particular examples, the anti-RSV antibody is a single chain antibody. A single-chain antibody can be generated from the antigen-binding domains of any of the anti-RSV antibodies or antigen-binding fragments thereof provided herein. Methods for generating single chain antibodies using recombinant techniques are known in the art, such as those described in, for example, Marasco et al. (1993) Proc. Natl. Acad. Sci. 90:7889-7893, Whitlow and Filpula (1991) *Methods,* 2: 97-105; Bird et al. (1988) *Science* 242:423-426; Pack et al. (1993) Bio/Technology 11:1271-77; and U.S. Pat. Nos. 4,946,778, 5,840,300, 5,667,988, 5,658,727.

A single chain antibody can contain a light chain variable ($V_L$) domain or functional region thereof and a heavy chain variable ($V_H$) domain or functional region thereof of any anti-RSV antibody or antigen-binding fragment thereof provided herein. In some examples, the $V_L$ domain or functional region thereof of the single chain antibody contains a complementarity determining region 1 (CDR1), a complementarity determining region 2 (CDR2) and/or a complementarity determining region 3 (CDR3) of an anti-RSV antibody or antigen-binding fragment thereof provided herein. In some examples, the $V_H$ domain or functional region thereof of the single chain antibody contains a complementarity determining region 1 (CDR1), a complementarity determining region 2 (CDR2) and a complementarity determining region 3 (CDR3) of any anti-RSV antibody or antigen-binding fragment thereof provided herein. In some examples, the single chain antibody further contains a peptide linker. In such examples, a peptide linker can be located between the light chain variable domain ($V_L$) and the heavy chain variable domain ($V_H$).

The single chain antibody can contain a peptide spacer, or linker, between the one or more domains of the antibody. For example, the light chain variable domain ($V_L$) of an antibody can be coupled to a heavy chain variable domain ($V_H$) via a flexible linker peptide. Various peptide linkers are well-known in the art and can be employed in the provided methods. A peptide linker can include a series of glycine residues (Gly) or Serine (Ser) residues. Exemplary of polypeptide linkers are peptides having the amino acid sequences $(Gly\text{-}Ser)_n$, $(Gly_mSer)_n$ or $(Ser_mGly)_n$, in which m is 1 to 6, generally 1 to 4, and typically 2 to 4, and n is 1 to 30, or 1 to 10, and typically 1 to 4, with some glutamic acid (Glu) or lysine (Lys) residues dispersed throughout to increase solubility (see, e.g., International PCT application No. WO 96/06641, which provides exemplary linkers for use in conjugates). Exemplary peptide linkers include, but are not limited to peptides having the sequence GGSSRSSSSGGGGSGGGG (SEQ ID NO: 1512), GSGRSGGGGSGGGGS (SEQ ID NO: 1513), EGKSSGSGSESKST (SEQ ID NO: 1514), EGKSSGSGSESKSTQ (SEQ ID NO: 1515), EGKSSGSGSESKVD (SEQ ID NO: 1516), GSTSGSGKSSEGKG (SEQ ID NO: 1517), KESGSVSSEQLAQFRSLD (SEQ ID NO: 1518), and ESGSVSSEELAFRSLD (SEQ ID NO: 1519). Generally, the linker peptides are approximately 1-50 amino acids in length. The linkers used herein also can increase intracellular availability, serum stability, specificity and solubility or provide increased flexibility or relieve steric hindrance. Linking moieties are described, for example, in Huston et al. (1988) *Proc Natl Acad Sci USA* 85:5879-5883, Whitlow et al. (1993) *Protein Engineering* 6:989-995, and Newton et al., (1996) *Biochemistry* 35:545-553. Other suitable peptide linkers include any of those described in U.S. Pat. No. 4,751,180 or 4,935,233, which are hereby incorporated by reference.

ii. Anti-Idiotypic Antibodies

The anti-RSV antibodies or antigen-binding fragments thereof provided herein can be utilized to generate anti-idiotype antibodies that "mimic" the RSV F protein antigen, to which the antibody immunospecifically binds, using techniques well known to those skilled in the art (see, e.g., Greenspan & Bona (1989) *FASEB J.* 7(5):437-444; and Nissinoff (1991) *J. Immunol.* 147(8):2429-2438). For example, the anti-RSV antibodies or antigen-binding fragments thereof provided herein which bind to and competitively inhibit the binding of RSV to its host cell receptor, as determined by assays well known in the art, can be used to generate anti-idiotypes that "mimic" a RSV antigen and bind to the RSV receptors, i.e., compete with the virus for binding to the host cell, therefore decreasing the infection rate of host cells with virus. In some examples, anti-anti-idiotypes can be generated by techniques well-known to the skilled artisan. The anti-anti-idiotypes mimic the binding domain of the anti-RSV antibody or antigen-binding fragment thereof and, as a consequence, bind to and neutralize RSV.

iii. Multi-Specific Antibodies and Antibody Multimerization

Two or more antibodies or antigen-binding fragments thereof provided herein can be engineered to form multivalent derivative antibodies, or multimers, such as bivalent, trivalent, tetravalent, pentavalent, hexavalent, heptavalent, or greater valency (i.e., containing 2, 3, 4, 5, 6, 7 or more antigen-binding sites) derivative antibodies. Such multivalent derivative antibodies can be monospecific, bispecific, trispecific or of greater multispecificity. In some examples, the multivalent derivative antibodies are monospecific, containing two or more antigen-binding domains that immunospecifically bind to the same epitope. In some examples, the multivalent derivative antibodies are multispecific, containing two or more antigen-binding domains that immunospecifically bind to two or more different epitopes. In some particular examples, the multivalent derivative antibodies are bivalent, containing two antigen-binding domains. Such bivalent antibodies can be homobivalent or heterobivalent antibodies, which immunospecifically bind to the same or different epitopes, respectively.

In some examples, the multispecific antibodies can immunospecifically bind to two or more different epitopes of RSV. Techniques for engineering multispecific antibodies are known in the art, and include, for example, linkage of two or more antigen-binding fragments via covalent, non-covalent, or chemical linkage. In some instances, multivalent derivative antibodies can be formed by dimerization of two or more anti-RSV antibodies or antigen-binding fragments thereof. Multimerization between two anti-RSV antibodies or antigen-binding fragments thereof can be spontaneous, or can occur due to forced linkage of two or more polypeptides. In one example, multimers of anti-RSV antibodies can be linked by disulfide bonds formed between cysteine residues on different anti-RSV antibodies. In another example, multivalent derivative antibodies can include anti-RSV antibodies or antigen-binding fragments thereof joined via covalent or non-covalent interactions to peptide moieties fused to the antibody or antigen-binding fragment thereof. Such peptides can be peptide linkers (spacers), or peptides that have the property of promoting multimerization. In some examples, multivalent derivative antibodies can be formed between two antibodies through chemical linkage, such as for example, by using heterobifunctional linkers.

Any multispecific and/or multivalent derivative antibody can be generated from the anti-RSV antibodies or antigen-binding fragments thereof provided herein provided that the antibody is biocompatible (e.g., for administration to animals, including humans) and maintains its activity, such as the binding to one or more epitopes of and/or neutralization of RSV. For the multispecific and multivalent derivative antibodies provided herein, the derivative antibody is at least immunospecific for an epitope recognized by 58c5 or sc5.

In some examples, the multispecific and/or multivalent antibody contains a $V_H$ CDR1 having the amino acid sequence set forth in SEQ ID NOS:2 or 10, a $V_H$ CDR2 having the amino acid sequence set forth in SEQ ID NOS:3 or 11, a $V_H$ CDR3 having the amino acid sequence set forth in SEQ ID NOS:4 or 12, a $V_L$ CDR1 having the amino acid sequence set forth in SEQ ID NOS:6 or 14, a $V_L$ CDR2 having the amino acid sequence set forth in SEQ ID NOS:7 or 15, a $V_L$ CDR3 having the amino acid sequence set forth in SEQ ID NOS:8 or 16, or any combination thereof.

In some examples, multispecific antibodies can be generated that immunospecifically bind to two or more epitopes of a RSV F protein (e.g., a RSV F protein having an amino acid sequence set forth in SEQ ID NO: 1527, 1629 or 1630). For example, the multispecific antibodies can immunospecifically bind to two or more different epitopes in the A, B or C antigenic regions of a RSV F protein. In some examples, multispecific antibodies can be generated that immunospecifically bind to an epitope of a RSV F protein and another RSV epitope. For example, the multispecific antibodies can immunospecifically bind to an epitope of a RSV F protein and an epitope of another RSV surface glycoprotein. In some examples, the multispecific antibodies can immunospecifically bind to an epitope of a RSV F protein and an epitope of a RSV protein selected from among a RSV attachment protein (e.g. having an amino acid sequence set forth in SEQ ID NO: 1520), a RSV RNA polymerase beta subunit large structural protein (L protein) (e.g. having an amino acid sequence set forth in SEQ ID NO: 1521), a RSV nucleocapsid protein (e.g. having an amino acid sequence set forth in SEQ ID NO: 1522), a RSV nucleoprotein (N) (e.g. having an amino acid sequence set forth in SEQ ID NO: 1523), a RSV phosphoprotein P (e.g. having an amino acid sequence set forth in SEQ ID NO: 1524), a RSV matrix protein (e.g. having an amino acid sequence set forth in SEQ ID NO: 1525), a RSV small hydrophobic (SH) protein (e.g. having an amino acid sequence set forth in SEQ ID NO: 1526), a RSV RNA-dependent polymerase, a RSV G protein (e.g. having an amino acid sequence set forth in SEQ ID NO: 1528), or an allelic variant of any of the above. In some examples, the multispecific antibodies can immunospecifically bind to an epitope of a RSV F protein and an epitope of a RSV G protein.

In some examples, the multispecific antibody contains an anti-RSV antigen-binding fragment derived from 58c5 or sc5 and an anti-RSV antigen-binding fragment derived from another anti-RSV antibody. In some examples, the multispecific antibody contains an anti-RSV antigen-binding fragment derived from 58c5 or sc5 and an anti-RSV antigen-binding fragment derived from an anti-RSV antibody selected among palivizumab (SYNAGIS®), and derivatives thereof, such as, but not limited to, motavizumab (NUMAX®), AFFF, P12f2, P12f4, P11d4, A1e9, A12a6, A13c4, A17d4, A4B4, A8c7, 1X-493L1, FR H3-3F4, M3H9, Y10H6, DG, AFFF(1), 6H8, L1-7E5, L2-15B10, A13a11, A1h5, A4B4(1), A4B4L1FR-S28R, A4B4-F52S (see, e.g., U.S. Pat. Nos. 5,824,307 and 6,818,216). In some examples, the multispecific antibody contains an anti-RSV antigen-binding fragment derived from 58c5 or sc5 and an anti-RSV antigen-binding fragment derived from a human anti-RSV antibody, such as, but not limited to, rsv6, rsv11, rsv13, rsv19 (i.e. Fab 19), rsv21, rsv22, rsv23, RF-1, and RF-2 (see, e.g. U.S. Pat. Nos. 6,685,942 and 5,811,524). In some examples, the multispecific antibody contains an anti-RSV antigen-binding fragment derived from 58c5 or sc5 and an anti-RSV antigen-binding fragment derived from an anti-RSV mouse monoclonal antibody such as, but not limited to, MAbs 1153, 1142, 1200, 1214, 1237, 1129, 1121, 1107, 1112, 1269, 1269, 1243 (Beeler et al. (1989) *J. Virology* 63(7):2841-2950), MAb151 (Mufson et al. (1987) *J. Clin. Microbiol.* 25:1635-1539), MAbs 43-1 and 13-1 (Fernie et al. (1982) *Proc. Soc. Exp. Biol. Med.* 171:266-271), MAbs 1436C, 1302A, 1308F, and 1331H (Anderson et al. (1984) *J. Clin. Microbiol.* 19:934-936), and humanized derivatives thereof. Additional exemplary antibodies or antigen-binding fragments thereof that can be used to generate a multispecific antibody that contains an anti-RSV antigen-binding fragment derived from 58c5 or sc5 include, but are not limited to, anti-RSV antibodies or antigen-binding fragments thereof described in, for example, U.S. Pat. Nos. 6,413,771, 5,840,298, 5,811,524, 6,656,467, 6,537,809, 7,364,742, 7,070,786, 5,955,364, 7,488,477, 6,818,216, 5,824,307, 7,364,737, 6,685,942, and 5,762,905 and U.S. Patent Pub. Nos. 2007-0082002, 2005-0175986, 2004-0234528, 2006-0198840, 2009-0110684, 2006-0159695, 2006-0013824, 2005-0288491, 2005-0019758, 2008-0226630, 2009-0137003, and 2009-0092609.

In some examples, multispecific antibodies or antigen-binding fragments can immunospecifically bind to an epitope of a RSV F protein and an epitope of another heterologous polypeptide or other antigenic material, such as, for example, a solid support material (see, e.g., International PCT Pub. Nos. WO 93/17715, WO 92/08802, WO 91/00360, and WO 92/05793; U.S. Pat. Nos. 4,474,893, 4,714,681, 4,925,648, 5,573,920, and 5,601,819; Tutt, et al., (1991) *J. Immunol.* 147:60-69; and Kostelny et al., (1992) *J. Immunol.* 148:1547-1553.

(1) Multimerization Via Peptide Linkers

Peptide linkers can be used to produce multivalent antibodies, such as, for example, a multimer where one multimerization partner is an anti-RSV antibody or antigen-binding fragment thereof provided herein. In one example, peptide linkers can be fused to the C-terminal end of a first polypeptide and the N-terminal end of a second polypeptide. This structure can be repeated multiples times such that at least one, such as 2, 3, 4, or more soluble polypeptides are linked to one another via peptide linkers at their respective termini. For example, a multimer polypeptide can have a sequence $Z_1$—X—$Z_2$, where $Z_1$ and $Z_2$ are each a sequence of an anti-RSV antigen-binding fragment (e.g. an anti-RSV single chain antibody; see, e.g., U.S. Pat. No. 6,759,518, describing multimerization of single chain antibodies) and where X is a sequence of a peptide linker. In some instances, $Z_1$ and/or $Z_2$ is an anti-RSV antigen-binding fragment provided herein. In another example, $Z_1$ and $Z_2$ are different anti-RSV antigen-binding fragments, where at least $Z_1$ or $Z_2$ is derived from anti-RSV antibody or antigen-binding fragment provided herein. In some examples, the multimer polypeptide has a sequence of $Z_1$—X—$Z_2$—(X—Z)$_n$, where "n" is any integer, i.e. generally 1 or 2. Typically, the peptide linker is of sufficient length to allow each anti-RSV antigen-binding fragment to bind its respective epitope without interfering with binding specificity of the antibody.

(2) Multimerization Via Heterobifunctional Linking Agents

Linkage of an anti-RSV antibody or antigen-binding fragment thereof provided herein to another anti-RSV antibody or antigen-binding fragment to create a multivalent antibody can be direct or indirect. For example, linkage of two or more anti-RSV antibodies or antigen-binding fragments can be achieved by chemical linkage or facilitated by heterobifunctional linkers, such as any known in the art or provided herein.

Numerous heterobifunctional cross-linking reagents that are used to form covalent bonds between amino groups and thiol groups and to introduce thiol groups into proteins are known to those of skill in this art (see, e.g., the PIERCE CATALOG, Immuno Technology Catalog & Handbook, 1992-1993, which describes the preparation of and use of such reagents and provides a commercial source for such reagents; see, also, e.g., Cumber et al., (1992) *Bioconjugate Chem.* 3:397-401; Thorpe et al., (1987) *Cancer Res.* 47:5924-5931; Gordon et al., (1987) *Proc. Natl. Acad Sci.* 84:308-312; Walden et al., (1986) *J. Mol. Cell Immunol.* 2:191-197; Carlsson et al., (1978) *Biochem. J.* 173: 723-737; Mahan et al., (1987) *Anal. Biochem.* 162:163-170; Wawryznaczak et al., (1992) *Br. J. Cancer* 66:361-366; Fattom et al., (1992) *Infection & Immun.* 60:584-589). These reagents can be used to form covalent bonds between two antibodies or between each of the antibodies and a linker. Exemplary reagents include, but are not limited to: N-succinimidyl-3-(2-pyridyldithio) propionate (SPDP; disulfide linker); sulfosuccinimidyl 6-[3-(2-pyridyldithio)propionamido]hexanoate (sulfo-LC-SPDP); succinimidyloxycarbonyl-α-methyl benzyl thiosulfate (SMBT, hindered disulfate linker); succinimidyl 6-[3-(2-pyridyldithio)propionamido]-hexanoate (LC-SPDP); sulfosuccinimidyl 4-(N-maleimidomethyl)cyclohexane-1-carboxylate (sulfo-SMCC); succinimidyl 3-(2-pyridyldithio)butyrate (SPDB; hindered disulfide bond linker); sulfosuccinimidyl 2-(7-azido-4-methylcoumarin-3-acetamide)ethyl-1,3'-dithiopropionate (SAED); sulfosuccinimidyl 7-azido-4-methylcoumarin-3-acetate (SAMCA); sulfosuccinimidyl-6-[alpha-methyl-alpha-(2-pyridyldithio) toluamido]-hexanoate (sulfo-LC-SMPT); 1,4-di-[3'-(2'-pyridyldithio)propion-amido]butane (DPDPB); 4-succinimidyloxycarbonyl-α-methyl-α-(2-pyridylthio) toluene (SMPT, hindered disulfate linker); sulfosuccinimidyl-6-[α-methyl-α-(2-pyrimiyldi-thio)toluamido]hexanoate (sulfo-LC-SMPT); m-maleimidobenzoyl-N-hydroxysuccinimide ester (MBS); m-maleimidobenzoyl-N-hydroxysulfo-succinimide ester (sulfo-MBS); N-succinimidyl(4-iodoacetyl)aminobenzoate (SIAB; thioether linker); sulfosuccinimidyl-(4-iodoacetyl)amino benzoate (sulfo-SIAB); succinimidyl-4-(p-maleimi-dophenyl)butyrate (SMPB); sulfosuccinimidyl4-(p-maleimidophenyl)butyrate (sulfo-SMPB); and azidobenzoyl hydrazide (ABH). In some examples, the linkers, can be used in combination with peptide linkers, such as those that increase flexibility or solubility or that provide for or eliminate steric hindrance. Any other linkers known to those of skill in the art for linking a polypeptide molecule to another molecule can be employed.

(3) Polypeptide Multimerization Domains

Interaction of two or more antigen-binding fragments to form multivalent and/or multispecific derivative antibodies can be facilitated by their linkage, either directly or indirectly, to any moiety or other polypeptide that are themselves able to interact to form a stable structure. For example, separate encoded polypeptide chains can be joined by multimerization, whereby multimerization of the polypeptides is mediated by a multimerization domain. Typically, the multimerization domain provides for the formation of a stable protein-protein interaction between a first chimeric polypeptide and a second chimeric polypeptide. Chimeric polypeptides include, for example, linkage (directly or indirectly) of one chain (e.g., a variable heavy domain chain or variable light chain domain) of an antibody or antigen-binding fragment thereof with a multimerization domain. Typically, the multimerization domain is linked to a heavy chain domain of the antibody or antigen-binding fragment thereof. Such chimeric polypeptides can be generated as a fusion proteins using recombinant techniques for fusing nucleic acid encoding the antibody chain to nucleic acid encoding the multimerization domain.

For the multivalent and/or multispecific derivative antibodies provided herein, at least one multimerization partner is an anti-RSV antibody or antigen-binding fragment thereof linked directly or indirectly to a multimerization domain. Homo- or heteromultimeric polypeptides can be generated from co-expression of separate chimeric polypeptides. The first and second chimeric polypeptides can be the same or different.

Generally, a multimerization domain includes any polypeptide capable of forming a stable protein-protein interaction with another polypeptide. The multimerization domains can interact, for example, via an immunoglobulin sequence (e.g., an Fc domain), a leucine zipper, a hydrophobic region, a hydrophilic region, or a free thiol which forms an intermolecular disulfide bond between the chimeric molecules of a homo- or heteromultimer. In addition, a multimerization domain can include an amino acid sequence comprising a protuberance complementary to an amino acid sequence comprising a hole or pocket, such as is described, for example, in U.S. Pat. No. 5,731,168. Such a multimerization region can be engineered such that steric interactions not only promote stable interaction, but further promote the formation of heterodimers over homodimers from a mixture of chimeric monomers.

In some examples, multivalent and/or multispecific antibodies are generated by linkage of two anti-RSV antigen-binding fragments via multimerization domain. In such examples, at least one of the antigen-binding fragments is derived from an anti-RSV antibody or antigen-binding fragment thereof provided herein, such as for example, 58c5 or sc5.

An antigen-binding polypeptide, such as for example anti-RSV antigen-binding fragment, can be conjugated to a multimerization domain to form a chimeric polypeptide. For anti-RSV antigen-binding fragments containing more than one chain (e.g., a variable heavy domain chain and a variable light chain domain), the multimerization domain can be conjugated to one of the chains, typically the heavy chain. The antigen-binding fragment is typically linked to the multimerization domain typically via its N- or C-terminus to the N- or C-terminus of the multimerization domain. Typically, the multimerization domain is conjugated to the C-terminus of the antigen-binding fragment (e.g., the C-terminus of a single chain antibody or the C-terminus of one chain of the antigen-binding fragment). The linkage can be direct or indirect via a linker. Also, the chimeric polypeptide can be a fusion protein or can be formed by chemical linkage, such as through covalent or non-covalent interactions. For example, when preparing a chimeric polypeptide containing a multimerization domain, nucleic acid encoding all or part of an anti-RSV antigen-binding fragment can be operably linked to nucleic acid encoding the multimerization domain sequence, directly or indirectly or optionally via a linker domain. Typically, the construct encodes a chimeric protein where the C-terminus of the anti-RSV antigen-binding fragment (or single chain of the antigen-binding fragment) is joined to the N-terminus of the multimerization domain.

A multivalent antibody provided herein contains two chimeric proteins created by linking, directly or indirectly, two of the same or different anti-RSV antigen-binding fragments directly or indirectly to a multimerization domain. In some examples, where the multimerization domain is a polypeptide, a gene fusion encoding the anti-RSV antigen-binding fragment (or single chain of the antigen-binding fragment) multimerization domain chimeric polypeptide is inserted into an appropriate expression vector. The resulting anti-RSV antigen-binding fragment-multimerization domain chimeric proteins can be expressed in host cells transformed with the recombinant expression vector, and allowed to assemble into multimers, where the multimerization domains interact to form multivalent antibodies. Chemical linkage of multimerization domains to anti-RSV antigen-binding fragments also can be effected using heterobifunctional linkers as discussed above. In some examples, the multivalent antibodies are multispecific antibodies that are derived from two or more anti-RSV antigen-binding fragments which bind to different epitopes.

The resulting chimeric polypeptides, and multivalent antibodies formed therefrom, can be purified by any suitable method known in the art, such as, for example, by affinity chromatography over Protein A or Protein G columns. Where two nucleic acid molecules encoding different anti-RSV antigen-binding chimeric polypeptides are transformed into cells, formation of homo- and heterodimers will occur. Conditions for expression can be adjusted so that heterodimer formation is favored over homodimer formation.

(a) Immunoglobulin Domain

Multimerization domains include those comprising a free thiol moiety capable of reacting to form an intermolecular disulfide bond with a multimerization domain of an additional amino acid sequence. For example, a multimerization domain can include a portion of an immunoglobulin molecule, such as from $IgG_1$, $IgG_2$, $IgG_3$, $IgG_4$, IgA, IgD, IgM, and IgE. Generally, the portion of an immunoglobulin selected for use as a multimerization domain is the constant region (Fc). Preparations of fusion proteins containing polypeptides fused to various portions of antibody-derived polypeptides, including the Fc domain, have been described (see, e.g., Ashkenazi et al. (1991) *PNAS* 88: 10535; Byrn et al. (1990) *Nature,* 344:677; and Hollenbaugh and Aruffo, (1992) "Construction of Immunoglobulin Fusion Proteins," in *Current Protocols in Immunology*, Suppl. 4, pp. 10.19.1-10.19.11).

In humans, there are five antibody isotypes classified based on their heavy chains denoted as delta (δ), gamma (γ), mu (μ), alpha (α) and epsilon (ϵ), giving rise to the IgD, IgG, IgM, IgA, and IgE classes of antibodies, respectively. The IgA and IgG classes contain the subclasses IgA1, IgA2, IgG1, IgG2, IgG3, and IgG4. Sequence differences between immunoglobulin heavy chains cause the various isotypes to differ in, for example, the number of constant (C) domains, the presence of a hinge region, and the number and location of interchain disulfide bonds. For example, IgM and IgE heavy chains contain an extra C domain (C4), that replaces the hinge region. The Fc regions of IgG, IgD, and IgA pair with each other through their Cγ3, Cδ3, and Cα3 domains, whereas the Fc regions of IgM and IgE dimerize through their Cμ4 and Cϵ4 domains. IgM and IgA form multivalent structures with ten and four antigen-binding sites, respectively.

Antigen-binding chimeric polypeptides provided herein include full-length immunoglobulin polypeptides (i.e., including all domains of full-length immunoglobulins). In some examples, the antigen-binding chimeric polypeptide is less than full length (e.g., the chimeric polypeptide can contain the antigen-binding domain and one or more immunoglobulin domains for multimerization, where the chimeric polypeptide is not a full-length immunoglobulin). In some examples, the anti-RSV antigen-binding chimeric polypeptides are assembled as monovalent or hetero- or homo-multivalent antibodies, such as bivalent, trivalent, tetravalent, pentavalent, hexavalent, heptavalent or higher valency antibodies. Chains or basic units of varying structures (e.g., one more heterologous constant regions or domains) can be utilized to assemble the monovalent and hetero- and homo-multivalent antibodies. Anti-RSV antigen-binding chimeric polypeptides can be readily produced and secreted by mammalian cells transformed with the appropriate nucleic acid molecule. In some examples, one or more than one nucleic acid fusion molecule can be transformed into host cells to produce a multivalent antibody where the anti-RSV antigen-binding portions of the multivalent antibody are the same or different. Typically, at least one of the anti-RSV antigen-binding portions of the multivalent antibody is derived from an anti-RSV antibody or antigen-binding fragment thereof provided herein, such as for example, 58c5 or sc5.

(i) Fc Domain

Exemplary multimerization domains that can be used to generate multivalent and/or multispecific antibodies containing an anti-RSV antigen-binding fragment provided herein include polypeptides derived from a heavy chain constant region or domain of a selected immunoglobulin molecule. Exemplary sequences of heavy chain constant regions for human IgG sub-types are set forth in SEQ ID NOS:1601 (IgG1), SEQ ID NO:1602 (IgG2), SEQ ID NO:1603 (IgG3), and SEQ ID NO:1604 (IgG4). For example, for the exemplary heavy chain constant region set forth in SEQ ID NO:1601, the $C_H1$ domain corresponds to amino acids 1-103, the hinge region corresponds to amino acids 104-119, the $C_H2$ domain corresponds to amino acids 120-223, and the $C_H3$ domain corresponds to amino acids 224-330.

In one example, an immunoglobulin polypeptide chimeric protein can include the Fc region of an immunoglobulin polypeptide. Typically, such a fusion retains at least a functionally active hinge, $C_H2$ and $C_H3$ domains of the constant region of an immunoglobulin heavy chain. For example, a full-length Fc sequence of IgG1 includes amino acids 104-330 of the sequence set forth in SEQ ID NO:1601. An exemplary Fc sequence for hIgG1 is set forth in SEQ ID NO:1605, and contains the hinge sequence corresponding to amino acids 104-119 of SEQ ID NO:1601, and the complete sequence for the $C_H2$ and $C_H3$ domain as set forth in SEQ ID NO:1601. Another exemplary Fc polypeptide is set forth in PCT application WO 93/10151, and is a single chain polypeptide extending from the N-terminal hinge region to the native C-terminus of the Fc region of a human IgG1 antibody (SEQ ID NO:1606). The precise site at which the linkage is made is not critical: particular sites are well known in the art and can be selected in order to optimize the biological activity, secretion, or binding characteristics of the anti-RSV antigen-binding chimeric polypeptide. For example, other exemplary Fc polypeptide sequences begin at amino acid C109 or P113 of the sequence set forth in SEQ ID NO:1601 (see e.g., US 2006/0024298).

In addition to hIgG1 Fc, other Fc regions also can be included in the anti-RSV antigen-binding chimeric polypeptides provided herein. For example, the Fc fusions can contain immunoglobulin sequences that are substantially encoded by immunoglobulin genes belonging to any of the antibody classes, including, but not limited to IgG (including human subclasses IgG1, IgG2, IgG3, or IgG4), IgA (including human subclasses IgA1 and IgA2), IgD, IgE, and IgM classes of antibodies.

In some examples, an Fc domain can be selected based on the functional properties of the domain, such as for example, the effector functions of the Fc domain in mediating an immune response. For example, where effector functions mediated by Fc/FcγR interactions are to be minimized, fusion with IgG isotypes that poorly recruit complement or effector cells, such as for example, the Fc of IgG2 or IgG4, can be used.

Modified Fc domains also are contemplated herein for use in chimeras with anti-RSV antigen-binding fragments, see e.g. U.S. Pat. No. 7,217,797; and U.S Pat. Pub. Nos. 2006/0198840, 2006/0024298 and 2008/0287657; and International Patent Pub. No. WO 2005/063816 for exemplary modifications. Exemplary amino acid modification of Fc domains also are provided elsewhere herein.

Typically, a bivalent antibody is a dimer of two chimeric proteins created by linking, directly or indirectly, two of the same or different anti-RSV antigen-binding fragments to an Fc polypeptide. In some examples, a gene fusion encoding the chimeric protein is inserted into an appropriate expression vector. The resulting chimeric proteins can be expressed in host cells transformed with the recombinant expression vector, and allowed to assemble, where interchain disulfide bonds form between the Fc moieties to yield divalent anti-RSV antibodies. Typically, a host cell and expression system is a mammalian expression system to allow for glycosylation of the chimeric protein. The resulting chimeric polypeptides containing Fc moieties, and multivalent antibodies formed therefrom, can be easily purified by affinity chromatography over Protein A or Protein G columns. Where two nucleic acids encoding different anti-RSV chimeric polypeptides are transformed into cells, the formation of heterodimers must be biochemically achieved since anti-RSV chimeric molecules carrying the Fc-domain will be expressed as disulfide-linked homodimers as well. Thus, homodimers can be reduced under conditions that favor the disruption of inter-chain disulfides, but do not effect intra-chain disulfides. Typically, chimeric monomers with different extracellular portions are mixed in equimolar amounts and oxidized to form a mixture of homo- and heterodimers. The components of this mixture are separated by chromatographic techniques.

Alternatively, the formation of a heterodimer can be biased by genetically engineering and expressing anti-RSV antigen-binding fusion molecules that contain an anti-RSV antigen-binding fragment, followed by the Fc-domain of hIgG, followed by either c-jun or the c-fos leucine zippers. Since the leucine zippers form predominantly heterodimers, they can be used to drive the formation of the heterodimers when desired. Anti-RSV chimeric polypeptides containing Fc regions also can be engineered to include a tag with metal chelates or other epitope. The tagged domain can be used for rapid purification by metal-chelate chromatography, and/or by antibodies, to allow for detection of western blots, immunoprecipitation, or activity depletion/blocking in bioassays.

D. ADDITIONAL MODIFICATIONS OF ANTI-RSV ANTIBODIES

The anti-RSV antibodies or antigen-binding fragments thereof provided herein can be further modified. Modifications of an anti-RSV antibody or antigen-binding fragment can improve one or more properties of the antibody, including, but not limited to, decreasing the immunogenicity of the antibody or antigen-binding fragment, improving the half-life of the antibody or antigen-binding fragment, such as reducing the susceptibility to proteolysis and/or reducing susceptibility to oxidation, and altering or improving of the binding properties of the antibody or antigen-binding fragment thereof. Exemplary modifications include, but are not limited to, modifications of the primary amino acid sequence of the anti-RSV antibody or antigen-binding fragment thereof and alteration of the post-translational modification of the anti-RSV antibody or antigen-binding fragment thereof. Exemplary post-translational modifications include, for example, glycosylation, acetylation, pegylation, phosphorylation, amidation, derivatization with protecting/blocking group, proteolytic cleavage, linkage to a cellular ligand or other protein. Other exemplary modifications include attachment of one or more heterologous peptides to the anti-RSV antibody or antigen-binding fragment to alter or improve one or more properties of the antibody or antigen-binding fragment thereof.

Generally, the modifications do not result in increased immunogenicity of the antibody or antigen-binding fragment thereof or significantly negatively affect the binding of the antibody or antigen-binding fragment thereof to RSV. Methods of assessing the binding of the modified antibodies or antigen-binding fragments thereof to a RSV F protein are provided herein and known in the art. For example, modified antibodies or antigen-binding fragments thereof can be assayed for binding to a RSV F protein by methods such as, but not limited to, ELISA, surface plasmon resonance (SPR), or through in vitro microneutralization assays.

Provided herein are methods of improving the half-life of the provided anti-RSV antibodies or antigen-binding fragments thereof Increasing the half-life of the anti-RSV antibodies or antigen-binding fragments thereof provided herein can increase the therapeutic effectiveness of the anti-RSV antibodies or antigen-binding fragments thereof and allow for less frequent administration of the antibodies or antigen-binding fragments thereof for prophylaxis and/or treatment, such as preventing or treating a RSV infection, preventing, treating, and/or alleviating of one or more symptoms of a RSV infection, or reducing the duration of a RSV infection.

Modification of the anti-RSV antibodies or antigen-binding fragments thereof produced herein can include one or more amino acid substitutions, deletions or additions, either from natural mutation or human manipulation from the parent antibody. Methods for modification of polypeptides, such as antibodies, are known in the art and can be employed for the modification of any antibody or antigen-binding fragment thereof provided herein. In some examples, the pharmacokinetic properties of the anti-RSV antibodies or antigen-binding fragments thereof provided herein can be enhanced through Fc modifications by techniques known to those skilled in the art. Standard techniques known to those skill in the art can be used to introduce mutations in the nucleotide molecule encoding an antibody or an antigen-binding fragment provided herein in order to produce an polypeptide with one or more amino acid substitutions. Exemplary techniques for introducing mutations include, but are not limited to, site-directed mutagenesis and PCR-mediated mutagenesis.

The anti-RSV antibodies and antigen-binding fragments thereof provided herein can be modified by the attachment of a heterologous peptide to facilitate purification. Generally such peptides are expressed as a fusion protein containing the antibody fused to the peptide at the C- or N-terminus of the antibody or antigen-binding fragment thereof. Exemplary peptides commonly used for purification include, but are not limited to, hexa-histidine peptides, hemagglutinin (HA) peptides, and flag tag peptides (see e.g., Wilson et al. (1984) *Cell* 37:767; Witzgall et al. (1994) *Anal Biochem* 223:2, 291-8). The fusion does not necessarily need to be direct, but can occur through a linker peptide. In some examples, the linker peptide contains a protease cleavage site which allows for removal of the purification peptide following purification by cleavage with a protease that specifically recognizes the protease cleavage site.

The anti-RSV antibodies and antigen-binding fragments thereof provided herein also can be modified by the attachment of a heterologous polypeptide that targets the antibody or antigen-binding fragment to a particular cell type (e.g., respiratory epithelial cells), either in vitro or in vivo. In some examples an anti-RSV antibody or antigen-binding fragment thereof provided herein can be targeted to a particular cell type by fusing or conjugating the antibody or antigen-binding fragment thereof to an antibody specific for a particular cell surface receptor or other polypeptide that interacts with a specific cell receptor.

In some examples, an anti-RSV antibody or antigen-binding fragment thereof provided herein can be targeted to a target cell surface and/or taken up by the target cell by fusing or conjugating the antibody or antigen-binding fragment thereof to a peptide that binds to cell surface glycoproteins, such as a protein transduction domain (e.g., a TAT peptide). Exemplary protein transduction domains include, but are not limited to, PTDs derived from proteins such as human immunodeficiency virus 1 (HIV-1) TAT (Ruben et al. (1989) *J. Virol.* 63:1-8; e.g., SEQ ID NOS: 1571-1582, such as for example, GRKKRRQRRR (TAT 48-57) SEQ ID NO:1575)), the herpes virus tegument protein VP22 (Elliott and O'Hare (1997) *Cell* 88:223-233; e.g., SEQ ID NO: 1587), the homeotic protein of *Drosophila melanogaster* Antennapedia (Antp) protein (Penetratin PTD; Derossi et al. (1996) *J. Biol. Chem.* 271:18188-18193; e.g., SEQ ID NOS: 1556-1559), the protegrin 1 (PG-1) anti-microbial peptide SynB (e.g., SynB1, SynB3, and Syn B4; Kokryakov et al. (1993) *FEBS Lett.* 327:231-236; e.g., SEQ ID NOS: 1568-1570, respectively) and basic fibroblast growth factor (Jans (1994) *FASEB J.* 8:841-847; e.g., SEQ ID NOS: 1552). PTDs also include synthetic PTDs, such as, but not limited to, polyarginine peptides (Futaki et al. (2003) *J. Mol. Recognit.* 16:260-264; Suzuki et al. (2001) *J. Biol. Chem.* 276:5836-5840; e.g. SEQ ID NOS: 1560-1561), transportan (Pooga et al. (1988) *FASEB J.* 12:67-77; Pooga et al. (2001) *FASEB J.* 15:1451-1453; e.g., SEQ ID NOS: 1583-1586), MAP (Oehlke et al. (1998) *Biochim. Biophys. Acta.* 1414:127-139; e.g., SEQ ID NO: 1550), KALA (Wyman et al. (1997) *Biochemistry* 36:3008-3017; e.g., SEQ ID NO: 1548) and other cationic peptides, such as, for example, various β-cationic peptides (Akkarawongsa et al. (2008) *Antimicrob. Agents and Chemother.* 52(6):2120-2129).

The anti-RSV antibodies and antigen-binding fragments thereof provided herein can be modified by the attachment of diagnostic and/or therapeutic moiety to the antibody or antigen-binding fragment thereof. The anti-RSV antibodies and antigen-binding fragments thereof provided herein can be modified by the covalent attachment of any type of molecule, such as a diagnostic or therapeutic molecule, to the antibody or antigen-binding fragment thereof such that covalent attachment does not prevent the antibody or antigen-binding fragment thereof from binding to its corresponding epitope. For example, an anti-RSV antibody or antigen-binding fragment thereof provided herein can be further modified by covalent attachment of a molecule such that the covalent attachment does not prevent the antibody or antigen-binding fragment thereof from binding to RSV. In some examples, the antibodies or antigen-binding fragments thereof can be recombinantly fused to a heterologous polypeptide at the N terminus or C terminus or chemically conjugated, including covalent and non-covalent conjugation, to a heterologous polypeptide or other composition. For example, the heterologous polypeptide or composition can be a diagnostic polypeptide or other diagnostic moiety or a therapeutic polypeptide or other therapeutic moiety. Exemplary diagnostic and therapeutic moieties include, but are not limited to, drugs, radionucleotides, toxins, fluorescent molecules (see, e.g. International PCT Publication Nos. WO 92/08495; WO 91/14438; WO 89/12624; U.S. Pat. No. 5,314,995; and EP 396,387). Diagnostic polypeptides or diagnostic moieties can be used, for example, as labels for in vivo or in vitro detection. Therapeutic polypeptides or therapeutic moieties can be used, for example, for therapy of a viral infection, such as RSV infection, or for treatment of one or more symptoms of a viral infection.

Additional fusion proteins of the anti-RSV antibodies or antigen-binding fragments thereof provided herein can be generated through the techniques of gene-shuffling, motif-shuffling, exon-shuffling, and/or codon-shuffling (collectively referred to as "DNA shuffling"). DNA shuffling can be employed to alter the activities of anti-RSV antibodies or antigen-binding fragments thereof provided herein, for example, to produce antibodies or antigen-binding fragments thereof with higher affinities and lower dissociation rates (see, generally, U.S. Pat. Nos. 5,605,793; 5,811,238; 5,830,721; 5,834,252; and 5,837,458, and Patten et al. (1997) *Curr. Opinion Biotechnol.* 8:724-33; Harayama (1998) *Trends Biotechnol.* 16(2):76-82; Hansson et al., (1999) *J. Mol. Biol.* 287:265-76; and Lorenzo and Blasco (1998) *Biotechniques* 24(2):308-13).

The provided anti-RSV antibodies or antigen-binding fragments thereof can also be attached to solid supports, which are useful for immunoassays or purification of the target antigen. Exemplary solid supports include, but are not limited to, glass, cellulose, polyacrylamide, nylon, polystyrene, polyvinyl chloride or polypropylene.

1. Modifications to Reduce Immunogenicity

In some examples, the antibodies or antigen-binding fragments thereof provided herein can be further modified to reduce the immunogenicity in a subject, such as a human subject. For example, one or more amino acids in the antibody or antigen-binding fragment thereof can be modified to alter potential epitopes for human T-cells in order to eliminate or reduce the immunogenicity of the antibody or antigen-binding fragment thereof when exposed to the immune system of the subject. Exemplary modifications include substitutions, deletions and insertion of one or more amino acids, which eliminate or reduce the immunogenicity of the antibody or antigen-binding fragment thereof. Generally, such modifications do not alter the binding specificity of the antibody or antigen-binding fragment thereof for its respective antigen. Reducing the immunogenicity of the antibody or antigen-binding fragment thereof can improve one or more properties of the antibody or antigen-binding fragment thereof, such as, for example, improving the therapeutic efficacy of the antibody or antigen-binding fragment thereof and/or increasing the half-life of the antibody or antigen-binding fragment thereof in vivo.

2. Fc Modifications

The anti-RSV antibodies or antigen-binding fragments thereof provided herein can contain a wild-type or modified Fc region. As described elsewhere herein, a Fc region can be linked to an anti-RSV antigen-binding fragment provided herein, such as, for example, 58c5 or sc5, or an antigen-binding fragment derived from 58c5 or sc5. In some examples, the Fc region can be modified to alter one or more properties of the Fc polypeptide. For example, the Fc region can be modified to alter (i.e. more or less) effector functions compared to the effector function of an Fc region of a wild-type immunoglobulin heavy chain. The Fc regions of an antibody interacts with a number of Fc receptors, and ligands, imparting an array of important functional capabilities referred to as effector functions. Fc effector functions include, for example, Fc receptor binding, complement fixation, and T cell depleting activity (see e.g., U.S. Pat. No. 6,136,310). Methods of assaying T cell depleting activity, Fc effector function, and antibody stability are known in the art. For example, the Fc region of an IgG molecule interacts with the FcγRs. These receptors are expressed in a variety of immune cells, including for example, monocytes, macrophages, neutrophils, dendritic cells, eosinophils, mast cells, platelets, B cells, large granular lymphocytes, Langerhans' cells, natural killer (NK) cells, and γδ T cells. Formation of the Fc/FcγR complex recruits these effector cells to sites of bound antigen, typically resulting in signaling events within the cells and important subsequent immune responses such as release of inflammation mediators, B cell activation, endocytosis, phagocytosis, and cytotoxic attack. The ability to mediate cytotoxic and phagocytic effector functions is a potential mechanism by which antibodies destroy targeted cells. Recognition of and lysis of bound antibody on target cells by cytotoxic cells that express FcγRs is referred to as antibody dependent cell-mediated cytotoxicity (ADCC). Other Fc receptors for various antibody isotypes include FcϵRs (IgE), FcαRs (IgA), and FcμRs (IgM).

Thus, a modified Fc domain can have altered affinity, including but not limited to, increased or low or no affinity for the Fc receptor. For example, the different IgG subclasses have different affinities for the FcγRs, with IgG1 and IgG3 typically binding substantially better to the receptors than IgG2 and IgG4. In addition, different FcγRs mediate different effector functions. FcγR1, FcγRIIa/c, and FcγRIIIa are positive regulators of immune complex triggered activation, characterized by having an intracellular domain that has an immunoreceptor tyrosine-based activation motif (ITAM). FcγRIIb, however, has an immunoreceptor tyrosine-based inhibition motif (ITIM) and is therefore inhibitory. Thus, altering the affinity of an Fc region for a receptor can modulate the effector functions induced by the Fc domain.

In one example, an Fc region is used that is modified for optimized binding to certain FcγRs to better mediate effector functions, such as for example, antibody-dependent cellular cytotoxicity, ADCC. Such modified Fc regions can contain modifications at one or more of amino acid residues (according to the Kabat numbering scheme, Kabat et al. (1991) Sequences of Proteins of Immunological Interest, U.S. Department of Health and Human Services), including, but not limited to, amino acid positions 249, 252, 259, 262, 268, 271, 273, 277, 280, 281, 285, 287, 296, 300, 317, 323, 343, 345, 346, 349, 351, 352, 353, and 424. For example, modifications in an Fc region can be made corresponding to any one or more of G119S, G119A, S122D, S122E, S122N, S122Q, S122T, K129H, K129Y, D132Y, R138Y, E141Y, T143H, V147I, S150E, H151D, E155Y, E155I, E155H, K157E, G164D, E166L, E166H, S181A, S181D, S187T, S207G, S307I, K209T, K209E, K209D, A210D, A213Y, A213L, A213I, I215D, I215E, I215N, I215Q, E216Y, E216A, K217T, K217F, K217A, and P279L of the exemplary IgG1 sequence set forth in SEQ ID NO:1601, or combinations thereof. A modified Fc containing these mutations can have enhanced binding to an FcR such as, for example, the activating receptor FcγIIIa and/or can have reduced binding to the inhibitory receptor FcγRIIb (see e.g., US 2006/0024298). Fc regions modified to have increased binding to FcRs can be more effective in facilitating the destruction of viral (e.g. RSV) infected cells in patients.

In some examples, the antibodies or antigen-binding fragments provided herein can be further modified to improve the interaction of the antibody or antigen-binding fragment thereof with the FcRn receptor in order to increase the in vivo half-life and pharmacokinetics of the antibody or antigen-binding fragment thereof (see, e.g. U.S. Pat. No. 7,217,797, U.S Pat. Pub. Nos. 2006/0198840 and 2008/0287657). FcRn is the neonatal FcR, the binding of which recycles endocytosed antibody or antigen-binding fragment thereof from the endosomes back to the bloodstream. This process, coupled with preclusion of kidney filtration due to the large size of the full length molecule, results in favorable antibody serum half-lives ranging from one to three weeks. Binding of Fc to FcRn also plays a role in antibody transport. Exemplary modifications of the Fc region include but are not limited to, mutation of the Fc described in U.S. Pat. No. 7,217,797; U.S Pat. Pub. Nos. 2006/0198840, 2006/0024298 and 2008/0287657, and International Patent Pub. No. WO 2005/

063816, such as mutations at one or more of amino acid residues (Kabat numbering, Kabat et al. (1991)) 251-256, 285-90, 308-314, in the $C_H2$ domain and/or amino acids residues 385-389, and 428-436 in the $C_H3$ domain of the Fc heavy chain constant region, where the modification alters Fc receptor binding affinity and/or serum half-life relative to unmodified antibody or antigen-binding fragment thereof. In some examples, the IgG constant domain is modified in the Fc region at one or more of amino acid positions 250, 251, 252, 254, 255, 256, 263, 308, 309, 311, 312 and 314 in the $C_H2$ domain and/or amino acid positions 385, 386, 387, 389, 428, 433, 434, 436, and 459 in the $C_H3$ domain of the IgG heavy chain constant region. Such modifications correspond to amino acids Gly120, Pro121, Ser122, Phe124, Leu125, Phe126, Thr133, Pro174, Arg175, Glu177, Gln178, and Asn180 in the $C_H2$ domain and amino acids Gln245, Val246, Ser247, Thr249, Ser283, Gly285, Ser286, Phe288, and Met311 in the $C_H3$ domain in an exemplary IgG1 sequence set forth in SEQ ID NO:1601. In some examples, the modification is at one or more surface-exposed residues, and the modification is a substitution with a residue of similar charge, polarity or hydrophobicity to the residue being substituted.

In particular examples, a Fc heavy chain constant region is modified at one or more of amino acid positions 251, 252, 254, 255, and 256 (Kabat numbering), where position 251 is substituted with Leu or Arg, position 252 is substituted with Tyr, Phe, Ser, Trp or Thr, position 254 is substituted with Thr or Ser, position 255 is substituted with Leu, Gly, Ile or Arg, and/or position 256 is substituted with Ser, Arg, Gln, Glu, Asp, Ala, Asp or Thr. In some examples, a Fc heavy chain constant region is modified at one or more of amino acid positions 308, 309, 311, 312, and 314, where position 308 is substituted with Thr or Ile, position 309 is substituted with Pro, position 311 is substituted with serine or Glu, position 312 is substituted with Asp, and/or position 314 is substituted with Leu. In some examples, a Fc heavy chain constant region is modified at one or more of amino acid positions 428, 433, 434, and 436, where position 428 is substituted with Met, Thr, Leu, Phe, or Ser, position 433 is substituted with Lys, Arg, Ser, Ile, Pro, Gln, or His, position 434 is substituted with Phe, Tyr, or His, and/or position 436 is substituted with His, Asn, Asp, Thr, Lys, Met, or Thr. In some examples, a Fc heavy chain constant region is modified at one or more of amino acid positions 263 and 459, where position 263 is substituted with Gln or Glu and/or position 459 is substituted with Leu or Phe.

In some examples, a Fc heavy chain constant region can be modified to enhance binding to the complement protein C1q. In addition to interacting with FcRs, Fc also interact with the complement protein C1q to mediate complement dependent cytotoxicity (CDC). C1q forms a complex with the serine proteases C1r and C1s to form the C1 complex. C1q is capable of binding six antibodies, although binding to two IgGs is sufficient to activate the complement cascade. Similar to Fc interaction with FcRs, different IgG subclasses have different affinity for C1q, with IgG1 and IgG3 typically binding substantially better than IgG2 and IgG4. Thus, a modified Fc having increased binding to C1q can mediate enhanced CDC, and can enhance destruction of viral (e.g., RSV) infected cells. Exemplary modifications in an Fc region that increase binding to C1q include, but are not limited to, amino acid modifications at positions 345 and 353 (Kabat numbering). Exemplary modifications are include those corresponding to K209W, K209Y, and E216S in an exemplary IgG1 sequence set forth in SEQ ID NO:1601.

In another example, a variety of Fc mutants with substitutions to reduce or ablate binding with FcγRs also are known. Such muteins are useful in instances where there is a need for reduced or eliminated effector function mediated by Fc. This is often the case where antagonism, but not killing of the cells bearing a target antigen is desired. Exemplary of such an Fc is an Fc mutein described in U.S. Pat. No. 5,457,035, which is modified at amino acid positions 248, 249 and 251 (Kabat numbering). In an exemplary IgG1 sequence set forth in SEQ ID NO:1601, amino acid 117 is modified from Leu to Ala, amino acid 118 is modified from Leu to Glu, and amino acid 120 is modified from Gly to Ala. Similar mutations can be made in any Fc sequence such as, for example, the exemplary Fc sequence. This mutein exhibits reduced affinity for Fc receptors.

The antibodies or antigen-binding fragments thereof provided herein can be engineered to contain modified Fc regions. For example, methods for fusing or conjugating polypeptides to the constant regions of antibodies (i.e. making Fc fusion proteins) are known in the art and described in, for example, U.S. Pat. Nos. 5,336,603, 5,622,929, 5,359,046, 5,349,053, 5,447,851, 5,723,125, 5,783,181, 5,908,626, 5,844,095, and 5,112,946; EP 307,434; EP 367,166; EP 394,827; PCT publications WO 91/06570, WO 96/04388, WO 96/22024, WO 97/34631, and WO 99/04813; Ashkenazi et al. (1991) *Proc. Natl. Acad. Sci. USA* 88:10535-10539; Traunecker et al. (1988) Nature 331:84-86; Zheng et al. (1995) *J. Immunol.* 154:5590-5600; and Vil et al. (1992) *Proc. Natl. Acad. Sci. USA* 89:11337-11341 (1992) and described elsewhere herein. In some examples, a modified Fc region having one or more modifications that increases the FcRn binding affinity and/or improves half-life can be fused to an anti-RSV antibody or antigen-binding fragment thereof provided herein.

3. Pegylation

The anti-RSV antibodies or antigen-binding fragments thereof provided herein can be conjugated to polymer molecules such as high molecular weight polyethylene glycol (PEG) to increase half-life and/or improve their pharmacokinetic profiles. Conjugation can be carried out by techniques known to those skilled in the art. Conjugation of therapeutic antibodies with PEG has been shown to enhance pharmacodynamics while not interfering with function (see, e.g., Deckert et al., *Int. J. Cancer* 87: 382-390, 2000; Knight et al., *Platelets* 15: 409-418, 2004; Leong et al., *Cytokine* 16: 106-119, 2001; and Yang et al., *Protein Eng.* 16: 761-770, 2003). PEG can be attached to the antibodies or antigen-binding fragments with or without a multifunctional linker either through site-specific conjugation of the PEG to the N- or C-terminus of the antibodies or antigen-binding fragments or via epsilon-amino groups present on lysine residues. Linear or branched polymer derivatization that results in minimal loss of biological activity can be used. The degree of conjugation can be monitored by SDS-PAGE and mass spectrometry to ensure proper conjugation of PEG molecules to the antibodies. Unreacted PEG can be separated from antibody-PEG conjugates by, e.g., size exclusion or ion-exchange chromatography. PEG-derivatized antibodies or antigen-binding fragments thereof can be tested for binding activity to RSV antigens as well as for in vivo efficacy using methods known to those skilled in the art, for example, by immunoassays described herein.

4. Conjugation of a Detectable Moiety

In some examples, the anti-RSV antibodies and antibody fragments provided herein can be further modified by conjugation to a detectable moiety. The detectable moieties can be detected directly or indirectly. Depending on the detectable moiety selected, the detectable moiety can be detected in vivo and/or in vitro. The detectable moieties can be employed, for example, in diagnostic methods for detecting exposure to RSV or localization of RSV or binding assays for determining the binding affinity of the anti-RSV antibody or antigen-binding fragment thereof for RSV. The detectable moieties also can be employed in methods of preparation of the anti-RSV antibodies, such as, for example, purification of the antibody or antigen-binding fragment thereof. Typically, detectable moieties are selected such that conjugation of the detectable moiety does not interfere with the binding of the antibody or antigen-binding fragment thereof to the target epitope. Generally, the choice of the detectable moiety depends on sensitivity required, ease of conjugation with the compound, stability requirements, available instrumentation, and disposal provisions. One of skill in the art is familiar with labels and can identify a detectable label suitable for and compatible with the assay employed. Methods of labeling antibodies with detectable moieties are known in the art and include, for example, recombinant and chemical methods.

The detectable moiety can be any material having a detectable physical or chemical property. Such detectable labels have been well-developed in the field of immunoassays and, in general, most any label useful in such methods can be applied in the methods provided. Thus, a label is any composition detectable by spectroscopic, photochemical, biochemical, immunochemical, electrical, optical or chemical means. Useful labels include, but are not limited to, fluorescent dyes (e.g., fluorescein isothiocyanate, Texas red, rhodamine, and the like), radiolabels (e.g., $^{3}H$, $^{125}I$, $^{35}S$, $^{14}C$, or $^{32}P$), in particular, gamma and positron emitting radioisotopes (e.g., $^{157}Gd$, $^{55}Mn$, $^{162}Dy$, $^{52}Cr$, and $^{56}Fe$), metallic ions (e.g., $^{111}In$, $^{97}Ru$, $^{67}Ga$, $^{68}Ga$, $^{72}As$, $^{89}Zr$, and $^{201}Tl$), enzymes (e.g., horse radish peroxidase, alkaline phosphatase and others commonly used in an ELISA), electron transfer agents (e.g., including metal binding proteins and compounds), luminescent and chemiluminescent labels (e.g., luciferin and 2,3-dihydrophtahlazinediones, e.g., luminol), magnetic beads (e.g., DYNABEADS™), and colorimetric labels such as colloidal gold or colored glass or plastic beads (e.g., polystyrene, polypropylene, latex, etc.). For a review of various labeling or signal producing systems that can be used, see e.g. U.S. Pat. No. 4,391,904.

5. Conjugation of a Therapeutic Moiety

In some examples, the anti-RSV antibodies and antigen-binding fragments provided herein can be further modified by conjugation to a therapeutic moiety. Exemplary therapeutic moieties include, but are not limited to, a cytotoxin (e.g., a cytostatic or cytocidal agent), a therapeutic agent or a radioactive metal ion (e.g., alpha-emitters). Exemplary cytotoxin or cytotoxic agents include, but are not limited to, any agent that is detrimental to cells, such as, but not limited to, paclitaxol, cytochalasin B, gramicidin D, ethidium bromide, emetine, mitomycin, etoposide, tenoposide, vincristine, vinblastine, colchicin, doxorubicin, daunorubicin, dihydroxy anthracin dione, mitoxantrone, mithramycin, actinomycin D, 1-dehydrotestosterone, glucocorticoids, procaine, tetracaine, lidocaine, propranolol, and puromycin and analogs or homologs thereof. Exemplary therapeutic agents include, but are not limited to, antimetabolites (e.g., methotrexate, 6-mercaptopurine, 6-thioguanine, cytarabine, 5-fluorouracil decarbazine), alkylating agents (e.g., mechlorethamine, thioepa chlorambucil, melphalan, carmustine (BSNU) and lomustine (CCNU), cyclothosphamide, busulfan, dibromomannitol, streptozotocin, mitomycin C, and cis-dichlorodiamine platinum (II) (DDP) cisplatin), anthracyclines (e.g., daunorubicin (formerly daunomycin) and doxorubicin), antibiotics (e.g., dactinomycin (formerly actinomycin), bleomycin, mithramycin, and anthramycin (AMC)), anti-mitotic agents (e.g., vincristine and vinblastine), and antivirals, such as, but not limited to, nucleoside analogs, such as zidovudine, acyclovir, gangcyclovir, vidarabine, idoxuridine, trifluridine, and ribavirin; foscamet, amantadine, rimantadine, saquinavir, indinavir, ritonavir, and alpha-interferons.

In some examples, the anti-RSV antibodies and antigen-binding fragments provided herein can be further modified by conjugation to a therapeutic moiety that is a therapeutic polypeptide. Exemplary therapeutic polypeptides include, but are not limited to, a toxin, such as abrin, ricin A, pseudomonas exotoxin, or diphtheria toxin; or an immunostimulatory agent, such as a cytokine, such as, but not limited to, an interferon (e.g., IFN-α, β, γ, ω), a lymphokine, a hematopoietic growth factor, such as, for example, GM-CSF (granulocyte macrophage colony stimulating factor), Interleukin-2 (IL-2), Interleukin-3 (IL-3), Interleukin-4 (IL-4), Interleukin-7 (IL-7), Interleukin-10 (IL-10), Interleukin-12 (IL-12), Interleukin-14 (IL-14), and Tumor Necrosis Factor (TNF).

6. Modifications to Improve Binding Specificity

The binding specificity of the anti-RSV antibodies and antibody fragments provided can be altered or improved by techniques, such as phage display. Methods for phage display generally involve the use of a filamentous phage (phagemid) surface expression vector system for cloning and expressing antibody species of the library. Various phagemid cloning systems to produce combinatorial libraries have been described by others. See, for example the preparation of combinatorial antibody libraries on phagemids as described by Kang et al., (1991) *Proc. Natl. Acad. Sci., USA,* 88:4363-4366; Barbas et al., (1991) *Proc. Natl. Acad. Sci., USA,* 88:7978-7982; Zebedee et al., (1992) *Proc. Natl. Acad. Sci., USA,* 89:3175-3179; Kang et al., (1991) *Proc. Natl. Acad. Sci., USA,* 88:11120-11123; Barbas et al., (1992) *Proc. Natl. Acad. Sci., USA,* 89:4457-4461; and Gram et al., (1992) *Proc. Natl. Acad. Sci., USA,* 89:3576-3580, which are incorporated herein by reference.

In particular examples, DNA sequences encoding $V_H$ and $V_L$ domains are amplified from animal cDNA libraries (e.g., human or murine cDNA libraries of lymphoid tissues). The DNA encoding the $V_H$ and $V_L$ domains are recombined together with an scFv linker by PCR and cloned into a phagemid vector (e.g., p CANTAB 6 or pComb 3 HSS). The vector is electroporated in *E. coli* and the *E. coli* is infected with helper phage. Phage used in these methods are typically filamentous phage including fd and M13 and the $V_H$ and $V_L$ domains are usually recombinantly fused to either the phage gene III or gene VIII. Phage expressing an antigen-binding domain that binds to a RSV antigen, for example, RSV F protein, can be selected or identified with antigen, e.g., using labeled antigen or antigen bound or captured to a solid surface or bead. Examples of phage display methods that can be used to make the antibodies by phage display include those disclosed, for example, in Brinkman et al. (1995) *J. Immunol. Methods* 182:41-50; Ames et al. (1995) *J. Immunol. Methods* 184:177-186; Kettleborough et al. (1994) *Eur. J. Immunol.* 24:952-958; Persic et al. (1997) *Gene* 187:9-18; Burton et al. (1994) *Advances in Immunology* 57:191-280; PCT publication Nos. WO 90/02809, WO 91/10737, WO 92/01047, WO 92/18619, WO 93/11236, WO 95/15982, WO 95/20401, and WO97/13844; and U.S. Pat. Nos. 5,698,426, 5,223,409, 5,403,484, 5,580,717, 5,427,908, 5,750,753, 5,821,047, 5,571,698, 5,427,908, 5,516,637, 5,780,225, 5,658,727, 5,733,743 and 5,969,108; each of which is incorporated herein by reference in its entirety.

As described in the above references, after phage selection, the antibody coding regions from the phage can be isolated and used to generate whole antibodies, including human antibodies, or any other desired antigen-binding fragment, and expressed in any desired host, including mammalian cells, insect cells, plant cells, yeast, and bacteria, e.g., as described herein. Techniques to recombinantly produce Fab, Fab' and $F(ab')_2$ fragments can also be employed using methods known in the art such as those disclosed in PCT publication No. WO 92/22324; Mullinax et al. (1992) *BioTechniques* 12(6):864-869; Sawai et al. (1995) *AJRI* 34:26-34; and Better et al. (1988) *Science* 240: 1041-1043.

The resulting phagemid library can be manipulated to increase and/or alter the immunospecificities of the antibodies or antigen-binding fragments to produce and subsequently identify additional antibodies with improved properties, such as increased binding to a target antigen. For example, either or both the heavy and light chain encoding DNA can be mutagenized in a complementarity determining region (CDR) of the variable region of the immunoglobulin polypeptide, and subsequently screened for desirable immunoreaction and neutralization capabilities. The resulting antibodies can then be screened in one or more of the assays described herein for determining neutralization capacity.

For some uses, including in vivo use of antibodies in humans and in vitro detection assays, human or chimeric antibodies are used. Completely human antibodies are particularly desirable for therapeutic treatment of human subjects. Human antibodies can be made by a variety of methods known in the art including phage display methods described above using antibody libraries derived from human immunoglobulin sequences or synthetic sequences homologous to human immunoglobulin sequences. See U.S. Pat. Nos. 4,444,887 and 4,716,111; and PCT publication Nos. WO 98/46645, WO 98/50433, WO 98/24893, WO98/16654, WO 96/34096, WO 96/33735, and WO 91/10741; each of which is incorporated herein by reference in its entirety.

E. METHODS OF ISOLATING ANTI-RSV ANTIBODIES

Anti-RSV antibodies or antigen-binding fragments thereof can be identified and isolated by a variety of techniques well-known in the art including, but not limited to, murine hybridomas (see, e.g., Olsson and Kaplan (1980) *Proc Natl Acad Sci USA* 77:5429-5431; such antibodies can be humanized as described elsewhere herein for use in humans), transgenic mice expressing human immunoglobulin genes (see, e.g., Kellerman and Green (2000) *Curr. Opin Biotechnol.* 13:593-597), phage display (see, e.g., Mancini (2004) *New Microbiol.* 27:315-28), and isolation from mature human immune cells, such as B cells (see, e.g., Banchereau and Rousset (1992) *Adv Immunol.* 52: 125-262, Crotty and Ahmed (2004) *Semin Immunol.* 16: 197-203, Carsetti (2004) *Methods Mol Biol.* 271: 25-35, McHeyzer-Williams and McHeyzer-Williams (2005) *Annu Rev Immunol.* 23:487-513). In an exemplary method provided herein, the human anti-RSV antibodies and antigen-binding fragments thereof provided herein are identified and isolated from human B cells.

Given the difficulty in obtaining stable hybridomas from human antibody secreting cells, an exemplary method that has been extensively used to produce and isolate human antibody-secreting cells is the immortalization of human B cells with Epstein Barr Virus (EBV), which is also known to induce polyclonal B cell activation and proliferation (see, e.g., Sugimoto et al., (2004) *Cancer Res.* 64:3361-3364; Bishop and Busch (2002) *Microbes Infect.* 4:853-857). Antibody-secreting cells have been produced, for example, by EBV immortalization of human B cells, such as the peripheral blood, lymph nodes, spleen, tonsils, or pleural fluids from patients or other individuals that can be exposed to the antigen or healthy subjects pre-selected using a labeled antigen (see, e.g., Casali et al. (1986) *Science* 234:476-9, Yamaguchi et al. (1987) *Proc Natl Acad Sci USA* 84:2416-2420, Posner et al. (1991) *J Immunol.* 146:4325-4332, Raff et al. (1988) *J Exp Med.* 168: 905-917, Steenbakkers et al. (1993) *Hum Antibod Hybrid.* 4:166-173, Steenbakkers et al. (1994) *Mol Biol Rep.* 19:125-134, Evans et al. (1988) *J Immunol* 140:941-943, and Wallis R et al. (1989) *J Clin Invest* 84:214-219).

Due to the low transformability, low clonability, and the inherent instability and heterogeneity of EBV-infected human B cells (Chan M et al. (1986) *J Immunol* 136:106-112 and James and Bell (1987) *J Immunol Methods.* 100:5-40), known techniques such as cell fusion, such as, for example with a myeloma cell line can be employed (see, e.g., Bron et al. (1984) *PNAS* 81:3214-3217; Yamaguchi et al. (1987) *Proc Natl Acad Sci USA* 84:2416-2420; Posner et al. (1991) *J Immunol.* 146:4325-4332, Niedbala and Stott (1998) *Hybridoma* 17:299-304; Li et al. (2006) *Proc Natl Acad Sci USA* 103:3557-62). Additional techniques for improving EBV immortalization include, for example, immortalization with oncogenic virus, transformation with oncogenes, mini-electrofusion, and mouse-human heterofusion in a single process (see, e.g., U.S. Pat. No. 4,997,764; Steenbakkers et al. (1993) *Hum Antibod Hybrid.* 4:166-173; Dessain et al. (2004) *J Immunol Methods.* 291:109-22). Human monoclonal antibodies can be isolated from B cells that have been activated and immortalized in the presence or in the absence of an antigen and by combining various manipulations in cell culture as described in the art (see e.g., Borrebaeck C et al. (1988) *Proc Natl Aacd Sci USA* 85: 3995-3999, Davenport et al. (1992) *FEMS Microbiol Immunol.* 4:335-343, Laroche-Traineau et al. (1994) *Hum Antib Hybrid.* 5:165-177, Morgenthaler et al. (1996) *J. Clin Endocrinology.* 81:3155-3161, Niedbala and Kurpisz (1993) *Immunol Lett.* 35:93-100, Mulder et al. (1993) *Hum Immunol.* 36:186-192, Hur et al. (2005) *Cell Prolif.* 38:35-45, Traggiai et al. (2004) *Nat Med* 10:871-875, Tsuchiyama et al. (1997) *Hum Antibodies* 8:43-47; and PCT Pub. Nos. WO 91109115, WO 041076677, WO 88101642, WO 90102795, WO 96140252, and WO 02146233).

Methods for the isolation of human antibodies from mature B cells, generally involve the isolation of a mature B cell population and screening antibodies expressed by the B cells against a particular antigen. A variety of different populations of antibody-secreting cells can be isolated from human donors having specific profiles (e.g. naive, vaccinated, more or less recently infected and seropositive individuals) and from different tissues (e.g. blood, tonsils, spleen, lymph nodes) where B cells reside and exert their activities (Viau and Zouali (2005) *Clin Immunol.* 114:17-26). In an exemplary method provided herein, anti-RSV antibodies provided herein can be isolated from a sample of peripheral blood mononuclear cells (PBMCs), which contain B cells, isolated from human donors and/or from healthy human donors that have been or have a high probability of having been exposed to RSV, such as health care workers.

After the isolation of PBMCs from the biological samples, a specific selection of antibody-secreting cells can be performed, using one of the various methods described in the art, on the basis of the expression of cell surface markers on their surface and, if appropriate, of other proteins, as well as the proliferation activity, the metabolic and/or morphological status of the cells. In particular, various technologies for the purification of antibody-secreting cells from human samples make use of different means and conditions for positive or negative selection. These cells are more easily and efficiently selected by physically separating those expressing cell surface markers specific for cells that express and secrete antibodies (e.g. human B cells). Specific protocols are known and can be found in the literature (see, e.g. Callard and Kotowicz "Human B-cell responses to cytokines" in Cytokine Cell Biology: A practical Approach. Balkwill F. (ed.) Oxford University Press, 2000, 17-31).

The selection of specific immune cells such as B cells, is typically performed using antibodies that bind specifically to a B-cell specific cell surface protein and that can be linked to solid supports (e.g. microbeads or plastic plates) or labeled with a fluorochrome that can be detected using fluorescence-activated cell sorting (FACS). For example, human B cells have been selected on the basis of their affinity for supports (such as microbeads) binding CD19, CD27, and/or CD22 microbeads, or for the lack of binding affinity for antibodies specific for certain isotypes prior to EBV immortalization (see, e.g., Li et al. (1995) *Biochem Biophys Res Commun* 207:985-993, Bernasconi et al. (2003) *Blood* 101:4500-4504 and Traggiai et al. (2004) *Nat Med* 10:871-875). The selection of the cell marker for purification can affect the efficiency of the immortalization process, for example, due to intracellular signals that are triggered by the selection process and that can alter cell growth and viability. For example, CD22, which is a B-cell restricted transmembrane protein that controls signal transduction pathways related to antigen recognition and B cell activation is an exemplary molecule for initial B cell selection. Since the CD22 positive population contains cells that express antibodies having different isotypes and specificities, other cell surface markers also can be used for selecting the cells, either before or after the stimulation phase.

In some examples, a specific enrichment of antibody-secreting cells can be obtained by applying a CD27-based selection in addition to the CD22-based selection. CD27 is known to be a marker for human B cells that have somatically mutated variable region genes (Borst J et al. (2005) *Curr Opin Immunol.* 17:275-281.). Additional markers such as CD5, CD24, CD25, CD86, CD38, CD45, CD70, or CD69 also can be used to either deplete or enrich for the desired population of cells. Thus, depending on factors, such as the donor's history of exposure to the antigen (e.g. an RSV antigen) and the antibody titer, total CD22-enriched B cells, or further enriched B cell subpopulations such as CD27 positive B cells can be selected.

Following cell selection, and before immortalization of the cells, the population of cells can be exposed to an appropriate stimulating agent. Exemplary stimulating agents include, for example, polyclonal B cell activators, such as, but not limited to, agonists of innate immune responses (e.g. Toll-like receptor agonists such as CpG oligonucleotides (Bernasconi et al. (2003) *Blood* 101:4500-4504, Bernasconi et al. (2002) *Science* 298:2199-2202, Bourke et al. (2003) *Blood* 102:956-63; e.g., CpG nucleotides, such as, for example, CpG2006, CpG2395, and CpG2395, available from Cell Sciences, Canton, Mass.) and immunomodulatory molecules such as cytokines (e.g., interleukins known to have immunostimulating activities, for example, IL-2, IL-4, IL-6, IL-10, and IL-13 (see Callard and Kotowicz "Human B-cell responses to cytokines" in Cytokine Cell Biology: A practical Approach. Balkwill F (ed.) Oxford University Press, 2000, 17-31) and agonists of cell membrane receptors of the TNF receptor family, in particular those activating the NF-κB pathway and proliferation in B cells, such as, but not limited to, APRIL, BAFF, CD 40 ligand (CD40L) (see, e.g., Schneider (2005) *Curr Opin Immunol.* 17:282-289, He et al. (2004) *J Immunol.* 172:3268-79, Craxton et al. (2003) *Blood* 101:4464-4471, and Tangye et al. (2003) *J Immunol.* 170:261-269). Exemplary methods of stimulating B cells using EBV immortalization in combination with or sequentially with one or more polyclonal activators are known in the art (see, e.g., Traggiai et al. (2004) *Nat Med* 10:871-875, Tsuchiyama et al. (1997) *Hum Antibodies* 8:43-47, Imadome et al. (2003) *Proc Natl Acad Sci USA* 100:7836-7840, and PCT Pub. Nos. WO 2007/068758, WO 04/76677, WO 91/09115, and WO 94/24164). The combination of stimulating agents can be added to the cell culture medium before the immortalization phase at the same time or sequentially (e.g. adding a first stimulating agent immediately after the initial cell selection and a second stimulating agent hours or days later). The stimulating agents can be directly added in the cell culture medium from diluted stock solutions, or after being appropriately formulated, for example, using liposomes or other compounds that can improve their uptake and immunostimulatory activity (Gursel et al. (2001) *J Immunol.* 167:3324-3328). The stimulating agents also can be attached to solid matrices (microbeads or directly on the cell culture plates), which can allow for effective removal of the agent(s). The cells can be washed with fresh medium one or more times and, optionally, maintained in normal cell culture medium (for example, from 1 up to 6 days) in order to further dilute and eliminate any remaining effect of the stimulating agents. The stimulating agent(s) also can be inhibited by adding specific compounds into the cell culture.

The cells can be further selected on the basis of the isotype of the expressed antibody after stimulating the cells and before exposing said selected and stimulated cells to the immortalizing agent (i.e. between the stimulation phase and the immortalization phase). The isotype-based selection of the cells can be performed by applying means for either positive (allowing the isolation of the specific cells) or negative (allowing the elimination of unwanted cells) selection. For example, a population of stimulated IgG positive cells can be selected positively (by FACS or magnetic cell separators) or by depleting cells that express IgM from the population of cells, and consequently enriching for cells that express IgG. Separation technologies for antibody-secreting cells using fluorescence activated or magnetic cell separators are known in the literature (see, e.g., Li et al. (1995) *Biochem Biophys Res Commun* 207:985-93, Traggiai et al. (2004) *Nat Med* 10:871-875). Depending on the source of antibody-secreting cells and their final use, depletion (or enrichment) of other isotype expressing cells, such as IgD or IgA expressing cells, also can be performed. A similar approach can be used for isolating cells on the basis of the specific subclass, if such a precise selection is desired (e.g., selection of human B cells that express IgG1, IgG2, IgG3, or IgG4 antibodies).

Various viral immortalization agents are known in the art and can be used on antibody-secreting cells to obtain immortalized antibody-secreting cells. Viruses that infect and immortalize antibody-secreting cells are commonly known as lymphotropic viruses. Exemplary of such viruses are those included in the gamma class of herpesviruses. Members of this virus family infect lymphocytes in a species-specific manner, and are associated with lymphoproliferative disorders and the development of several malignancies (Nicholas (2000) *J. Mol Pathol.* 53:222-237 and Rickinson (2001) *Philos Trans R Soc Lond B Biol Sci.* 356:595-604). Exemplary viruses for use as an immortalization agent in the methods provide include EBV (Epstein-Barr virus, also known as herpesvirus 4), and HHV-8 (human herpesvirus 8, also known as KSHV, Kaposi's Sarcoma associated Herpesvirus), which can infect and immortalize human lymphocytes. Other exemplary viruses for use in the methods include, but are not limited to, MHV-68 (murine herpesvirus 68), HVS (herpesvirus Samiri), RRV (Rhesus Rhadinovirus), LCV (primate Lymphocryptovirus), EHV-2 (Equine Herpesvirus 2) HVA (Herpesvirus Ateles), and AHV-1 (Alcelaphine Herpesvirus 1), which are other oncogenic, lymphotropic herpesvirus having some common genetic features conserved amongst them and similar pathogenic effects in different mammalian host cells.

Recombinant DNA constructs that contain specific viral proteins from viruses employed for immortalize also have been used to immortalize B cells (see Damania (2004) *Nat Rev Microbiol.* 2:656-668 and Kilger et al. (1998) *EMBO J.* 17:1700-1709). Similar vectors containing viral genes can be transduced into cells in the methods provided. Methods of making such constructs are well-known in the art and include, for example, the use of retroviral systems or virus-like particles and packaging cell lines, which provide all the necessary factors in trans for the formation of such particles.

The immortalization phase can last between one and several hours, up to 2-4 days. The length of immortalization phase can be adjusted depending of various factors such as cell viability and efficiency of immortalization. In some examples, the cells are immortalized with EBV for a period of about 4 to about 24 hours. In a particular example, the cells are immortalized with EBV for a period of about 16 hours.

EBV-mediated immortalization of B cells requires the expression of the cell surface receptor CD21, which is considered as the main EBV receptor. CD21 is present on most B cell subpopulations and regulates B cell responses by forming a complex with CD19 and the B cell antigen receptor (Fearon and Carroll (2000) *Ann Rev Immun.* 18:393-422). The ability to transform cells with EBV can be enhanced by the addition of B cell stimulating agents, but the conditions must ensure that CD21 is maintained on the cell surface, allowing EBV immortalization at high efficiency.

Following the immortalization phase, the immortalized cells can cultured at a low density on feeder cell layers. The feeder layer can be constituted by irradiated non-allogeneic peripheral blood cell preparations, lymphoblastoid or fibroblast cell lines, cord blood lymphocytes, or different types of embryonic cells. An example of a cell line having such properties is EL4-B5, mutant EL4 thymoma cell lines that efficiently support the growth and the proliferation of B cells. Other exemplary feeder cells include irradiated B-cell depleted PMBC feeder cells as described elsewhere herein. Growth promoting agents such as those used to stimulate the B cell population also can be used to maintain the immortalized B cell population following immortalization.

The immortalized populations of cells can be used for a series of applications, in particular related to antibody isolation, characterization and production. In some examples, DNA libraries encoding the antibodies expressed by the cells or fragments of such antibodies can be constructed from DNA isolated from the bulk population of cells using common recombinant techniques. In some examples as described herein, the immortalized cells can be further cultured and divided into pools of antibody-secreting cells. The pools of cells can be cultured, for example, on feed cell layers.

In some examples, cell culture supernatants from the pools of cells are screened in one or more rounds, for the identification of cells that express antibodies having a particular antigen specificity (e.g., antibodies that immunospecifically bind a RSV F protein). Exemplary methods for screening antibodies and measuring binding specificity are described elsewhere herein and are known in the art. Once a particular antibody is identified, DNA encoding the antibody or antigen-binding portions thereof can be isolated from the pools of cells using well-known recombinant methods. As described herein, DNA isolated from the pools of cells can then be expressed (e.g., in a prokaryotic or eukaryotic host cell) and re-screened for the identification of individual clones that express the desired antibody or antigen-binding fragment thereof.

In some examples as described herein, the immortalized cells can be single cell sorted using a cell sorter (e.g., FACS), using a labeled antigen. In a particular example, cells expressing anti-RSV antibodies can be isolated using an RSV F antigen labeled with Alexa Fluor 647 in order to label the desired cells. Following sorting, DNA encoding the anti-RSV antibody or antigen-binding fragment thereof can then be isolated using well-known recombinant methods. DNA isolated from the pools of cells can be expressed (e.g., in a prokaryotic or eukaryotic host cell) to confirm binding to the RSV antigen.

Typically, the screening methods employed for the identification of individual antibodies that bind to a particular antigen result in the identification of the antigen-binding portion of such antibodies. To generate full length or other derivative antibodies from the antigen-binding fragment, nucleotide sequences encoding the $V_H$ and/or $V_L$ chain or antigen-binding portions thereof can be isolated and cloned into vectors expressing a $V_H$ constant region (e.g., the human gamma 1 constant region), $V_L$ constant region (e.g., human kappa or lambda constant regions), respectively. The $V_H$ and $V_L$ domains also can be cloned into a vector expressing the selected constant regions. The heavy chain conversion vectors and light chain conversion vectors are then co-transfected into cell lines to generate stable or transient cell lines that express full-length antibodies, e.g., IgG, using techniques known to those of skill in the art.

F. METHODS OF PRODUCING ANTI-RSV ANTIBODIES, AND MODIFIED OR VARIANT FORMS THEREOF AND NUCLEIC ACIDS ENCODING ANTIBODIES

The anti-RSV antibodies or antigen-binding fragments thereof provided herein can be generated by any suitable method known in the art for the preparation of antibodies, including chemical synthesis and recombinant expression techniques. Various combinations of host cells and vectors can be used to receive, maintain, reproduce and amplify nucleic acids (e.g. nucleic acids encoding antibodies such as the anti-RSV antibodies or antigen-binding fragments thereof provided), and to express polypeptides encoded by the nucleic acids. In general, the choice of host cell and vector depends on whether amplification, polypeptide expression, and/or display on a genetic package, such as a phage, is desired. Methods for transforming host cells are well known. Any known transformation method (e.g., transformation, transfection, infection, electroporation and sonoporation) can be used to transform the host cell with nucleic acids. Procedures for the production of antibodies, such as monoclonal antibodies and antibody fragments, such as, but not limited to, Fab fragments and single chain antibodies are well known in the art.

Monoclonal antibodies can be prepared using a wide variety of techniques known in the art including, but not limited to, the use of hybridoma, recombinant expression, phage display technologies or a combination thereof. For example, monoclonal antibodies can be produced using hybridoma techniques including those known in the art and taught, for example, in Harlow et al., Antibodies: A Laboratory Manual (Cold Spring Harbor Laboratory Press, 2nd ed. 1988); Hammerling, Monoclonal Antibodies and T-Cell Hybridomas 5630681 (Elsevier N.Y. 1981).

Polypeptides, such as any set forth herein, including the anti-RSV antibodies or antigen-binding fragments thereof provided herein, can be produced by any method known to those of skill in the art including in vivo and in vitro methods. Desired polypeptides can be expressed in any organism suitable to produce the required amounts and forms of the proteins, such as for example, needed for analysis, administration and treatment. Expression hosts include prokaryotic and eukaryotic organisms such as *E. coli*, yeast, plants, insect cells, mammalian cells, including human cell lines and transgenic animals (e.g., rabbits, mice, rats, and livestock, such as, but not limited to, goats, sheep, and cattle), including production in serum, milk and eggs. Expression hosts can differ in their protein production levels as well as the types of post-translational modifications that are present on the expressed proteins. The choice of expression host can be made based on these and other factors, such as regulatory and safety considerations, production costs and the need and methods for purification.

1. Nucleic Acids

Provided herein are isolated nucleic acid molecules encoding an anti-RSV antibody or antigen-binding fragment thereof provided herein. In some examples, the isolated nucleic acid molecule encodes an antibody that is 58c5. In some examples, the isolated nucleic acid molecule encodes an antigen-binding fragment that is an antigen-binding fragment of 58c5.

In some examples, the isolated nucleic acid molecule provided encodes an antibody or antigen-binding fragment thereof containing a heavy chain having an amino acid sequence set forth in SEQ ID NO:1. In some examples, the isolated nucleic acid molecule provided contains a nucleic acid having a sequence of nucleotides set forth in SEQ ID NO:18.

In some examples, the isolated nucleic acid molecule provided encodes an antibody or antigen-binding fragment thereof containing a light chain having an amino acid sequence set forth in SEQ ID NO:5. In some examples, the isolated nucleic acid molecule provided contains a nucleic acid having a sequence of nucleotides set forth in SEQ ID NO:17.

In some examples, the isolated nucleic acid molecule provided encodes an antibody or fragment thereof containing a $V_H$ CDR1 having an amino acid sequence set forth in SEQ ID NO:2 or 1627. In some examples, the isolated nucleic acid molecule provided encodes an antibody or fragment thereof containing a $V_H$ CDR2 having an amino acid sequence set forth in SEQ ID NO:3. In some examples, the isolated nucleic acid molecule provided encodes an antibody or fragment thereof containing a $V_H$ CDR3 having an amino acid sequence set forth in SEQ ID NO:4.

In some examples, the isolated nucleic acid molecule provided encodes an antibody or fragment thereof containing a $V_L$ CDR1 having an amino acid sequence set forth in SEQ ID NO:6. In some examples, the isolated nucleic acid molecule provided encodes an antibody or fragment thereof containing a $V_L$ CDR2 having an amino acid sequence set forth in SEQ ID NO:7. In some examples, the isolated nucleic acid molecule provided encodes an antibody or fragment thereof containing a $V_L$ CDR3 having an amino acid sequence set forth in SEQ ID NO:8.

Nucleic acid molecules encoding the anti-RSV antibodies or antigen-binding fragments thereof provided herein can be prepared using well-known recombinant techniques for manipulation of nucleic acid molecules (see, e.g., techniques described in Sambrook et al. (1990) Molecular Cloning, A Laboratory Manual, 2d Ed., Cold Spring Harbor Laboratory, Cold Spring Harbor, N.Y. and Ausubel et al., eds. (1998) Current Protocols in Molecular Biology, John Wiley & Sons, NY). In some examples, methods, such as, but not limited to, recombinant DNA techniques, site directed mutagenesis, and polymerase chain reaction (PCR) can be used to generate modified antibodies or antigen-binding fragments thereof having a different amino acid sequence, for example, to create amino acid substitutions, deletions, and/or insertions.

In some examples, one or more of the CDRs of an anti-RSV antibody or antigen-binding fragment thereof provided herein is inserted within framework regions using routine recombinant DNA techniques. The framework regions can be selected from naturally occurring or consensus framework regions, including human framework regions (see, e.g., Chothia et al. (1998) *J. Mol. Biol.* 278: 457-479 for exemplary framework regions). Generally, the polynucleotide generated by the combination of the framework regions and CDRs encodes an antibody or antigen-binding fragment thereof that maintains the antigen-binding specificity of the parent anti-RSV antibody or antigen-binding fragment thereof. Alterations to the polynucleotide can be made to improve one or more properties of the encoded antibody or antigen-binding fragment thereof and within the skill of the art. In some examples, one or more modifications of the polynucleotide can be made to produce amino acid substitutions within the framework regions, which, for example, improve binding of the antibody or antigen-binding fragment thereof to its antigen. Additionally, such methods can be used to make amino acid substitutions or deletions of one or more variable region cysteine residues participating in an intrachain disulfide bond to generate antibody molecules lacking one or more intrachain disulfide bonds.

2. Vectors

Provided herein are vectors that contain nucleic acid encoding the anti-RSV antibodies or antigen-binding fragments thereof. Many expression vectors are available and known to those of skill in the art and can be used for expression of polypeptides. The choice of expression vector will be influenced by the choice of host expression system. Such selection is well within the level of skill of the skilled artisan. In general, expression vectors can include transcriptional promoters and optionally enhancers, translational signals, and transcriptional and translational termination signals. Expression vectors that are used for stable transformation typically have a selectable marker which allows selection and maintenance of the transformed cells. In some cases, an origin of replication can be used to amplify the copy number of the vector in the cells.

Vectors also can contain additional nucleotide sequences operably linked to the ligated nucleic acid molecule, such as, for example, an epitope tag such as for localization, e.g. a hexa-his tag or a myc tag, or a tag for purification, for example, a GST fusion, and a sequence for directing protein secretion and/or membrane association.

Expression of the antibodies or antigen-binding fragments thereof can be controlled by any promoter/enhancer known in the art. Suitable bacterial promoters are well known in the art and described herein below. Other suitable promoters for mammalian cells, yeast cells and insect cells are well known in the art and some are exemplified below. Selection of the promoter used to direct expression of a heterologous nucleic acid depends on the particular application and is within the level of skill of the skilled artisan. Promoters which can be used include but are not limited to eukaryotic expression vectors containing the SV40 early promoter (Bernoist and Chambon, (1981) *Nature* 290:304-310), the promoter contained in the 3' long terminal repeat of Rous sarcoma virus (Yamamoto et al. (1980) *Cell* 22:787-797), the herpes thymidine kinase promoter (Wagner et al., (1981) *Proc. Natl. Acad. Sci. USA* 78:1441-1445), the regulatory sequences of the metallothionein gene (Brinster et al., (1982) *Nature* 296:39-42); prokaryotic expression vectors such as the β-lactamase promoter (Jay et al., (1981) *Proc. Natl. Acad. Sci. USA* 78:5543) or the tac promoter (DeBoer et al., (1983) *Proc. Natl. Acad. Sci. USA* 80:21-25); see also "Useful Proteins from Recombinant Bacteria": in Scientific American 242:79-94 (1980)); plant expression vectors containing the nopaline synthetase promoter (Herrera-Estrella et al., (1984) *Nature* 303:209-213) or the cauliflower mosaic virus 35S RNA promoter (Gardner et al., (1981) *Nucleic Acids Res.* 9:2871), and the promoter of the photosynthetic enzyme ribulose bisphosphate carboxylase (Herrera-Estrella et al., (1984) *Nature* 310:115-120); promoter elements from yeast and other fungi such as the Gal4 promoter, the alcohol dehydrogenase promoter, the phosphoglycerol kinase promoter, the alkaline phosphatase promoter, and the following animal transcriptional control regions that exhibit tissue specificity and have been used in transgenic animals: elastase I gene control region which is active in pancreatic acinar cells (Swift et al., (1984) *Cell* 38:639-646; Ornitz et al., (1986) *Cold Spring Harbor Symp. Quant. Biol.* 50:399-409; MacDonald, (1987) *Hepatology* 7:425-515); insulin gene control region which is active in pancreatic beta cells (Hanahan et al., (1985) *Nature* 315:115-122), immunoglobulin gene control region which is active in lymphoid cells (Grosschedl et al., (1984) *Cell* 38:647-658; Adams et al., (1985) *Nature* 318:533-538; Alexander et al., (1987) *Mol. Cell Biol.* 7:1436-1444), mouse mammary tumor virus control region which is active in testicular, breast, lymphoid and mast cells (Leder et al., (1986) *Cell* 45:485-495), albumin gene control region which is active in liver (Pinckert et al., (1987) *Genes and Devel.* 1:268-276), alpha-fetoprotein gene control region which is active in liver (Krumlauf et al., (1985) *Mol. Cell. Biol.* 5:1639-1648); Hammer et al., (1987) *Science* 235:53-58), alpha-1 antitrypsin gene control region which is active in liver (Kelsey et al., (1987) *Genes and Devel.* 1:161-171), beta globin gene control region which is active in myeloid cells (Magram et al., (1985) *Nature* 315:338-340); Kollias et al., (1986) *Cell* 46:89-94), myelin basic protein gene control region which is active in oligodendrocyte cells of the brain (Readhead et al., (1987) *Cell* 48:703-712), myosin light chain-2 gene control region which is active in skeletal muscle (Shani (1985) *Nature* 314:283-286), and gonadotrophic releasing hormone gene control region which is active in gonadotrophs of the hypothalamus (Mason et al., (1986) *Science* 234:1372-1378).

In addition to the promoter, the expression vector typically contains a transcription unit or expression cassette that contains all the additional elements required for the expression of the antibody, or portion thereof, in host cells. A typical expression cassette contains a promoter operably linked to the nucleic acid sequence encoding the germline antibody chain and signals required for efficient polyadenylation of the transcript, ribosome binding sites and translation termination. Additional elements of the cassette can include enhancers. In addition, the cassette typically contains a transcription termination region downstream of the structural gene to provide for efficient termination. The termination region can be obtained from the same gene as the promoter sequence or can be obtained from different genes.

Some expression systems have markers that provide gene amplification such as thymidine kinase and dihydrofolate reductase. Alternatively, high yield expression systems not involving gene amplification are also suitable, such as using a baculovirus vector in insect cells, with a nucleic acid sequence encoding a germline antibody chain under the direction of the polyhedron promoter or other strong baculovirus promoter.

Any methods known to those of skill in the art for the insertion of DNA fragments into a vector can be used to construct expression vectors containing a nucleic acid encoding an antibody or antigen-binding fragment thereof provided herein. These methods can include in vitro recombinant DNA and synthetic techniques and in vivo recombinants (genetic recombination). The insertion into a cloning vector can, for example, be accomplished by ligating the DNA fragment into a cloning vector which has complementary cohesive termini. If the complementary restriction sites used to fragment the DNA are not present in the cloning vector, the ends of the DNA molecules can be enzymatically modified. Alternatively, any site desired can be produced by ligating nucleotide sequences (linkers) onto the DNA termini; these ligated linkers can contain specific chemically synthesized nucleic acids encoding restriction endonuclease recognition sequences.

Exemplary plasmid vectors useful to produce the antibodies or antigen-binding fragments provided herein contain a strong promoter, such as the HCMV immediate early enhancer/promoter or the MHC class I promoter, an intron to enhance processing of the transcript, such as the HCMV immediate early gene intron A, and a polyadenylation (polyA) signal, such as the late SV40 polyA signal. The plasmid can be multicistronic to enable expression of the full-length heavy and light chains of the antibody, a single chain Fv fragment or other immunoglobulin fragments.

3. Cell Expression Systems

Nucleic acids encoding the anti-RSV antibodies or antigen-binding fragments thereof provided herein can be expressed in a suitable host. Cells containing the vectors and nucleic acids encoding the anti-RSV antibodies or antigen-binding fragments thereof provided herein are provided. Generally, any cell type that can be engineered to express heterologous DNA and has a secretory pathway is suitable. Expression hosts include prokaryotic and eukaryotic organisms, such as bacterial cells (e.g. *E. coli*), yeast cells, fungal cells, Archae, plant cells, insect cells and animal cells including human cells. Expression hosts can differ in their protein production levels as well as the types of post-translational modifications that are present on the expressed proteins. Further, the choice of expression host is often related to the choice of vector and transcription and translation elements used. For example, the choice of expression host is often, but not always, dependent on the choice of precursor sequence utilized. For example, many heterologous signal sequences can only be expressed in a host cell of the same species (i.e., an insect cell signal sequence is optimally expressed in an insect cell). In contrast, other signal sequences can be used in heterologous hosts such as, for example, the human serum albumin (hHSA) signal sequence which works well in yeast, insect, or mammalian host cells and the tissue plasminogen activator pre/pro sequence which has been demonstrated to be functional in insect and mammalian cells (Tan et al., (2002) *Protein Eng.* 15:337). The choice of expression host can be made based on these and other factors, such as regulatory and safety considerations, production costs and the need and methods for purification. Thus, the vector system must be compatible with the host cell used.

Expression in eukaryotic hosts can include expression in yeasts such as *Saccharomyces cerevisiae* and *Pichia pastoris*, insect cells such as *Drosophila* cells and *lepidopteran* cells, plants and plant cells such as tobacco, corn, rice, algae, and lemna. Eukaryotic cells for expression also include mammalian cells lines such as Chinese hamster ovary (CHO) cells or baby hamster kidney (BHK) cells. Eukaryotic expression hosts also include production in transgenic animals, for example, including production in serum, milk and eggs.

Recombinant molecules can be introduced into host cells via, for example, transformation, transfection, infection, electroporation and sonoporation, so that many copies of the gene sequence are generated. Generally, standard transfection methods are used to produce bacterial, mammalian, yeast, or insect cell lines that express large quantity of antibody chains, which is then purified using standard techniques (see e.g., Colley et al. (1989) *J. Biol. Chem.,* 264:17619-17622; Guide to Protein Purification, in Methods in Enzymology, vol. 182 (Deutscher, ed.), 1990). Transformation of eukaryotic and prokaryotic cells are performed according to standard techniques (see, e.g., Morrison (1977) *J. Bact.* 132: 349-351; Clark-Curtiss and Curtiss (1983) *Methods in Enzymology,* 101, 347-362). For example, any of the well-known procedures for introducing foreign nucleotide sequences into host cells can be used. These include the use of calcium phosphate transfection, polybrene, protoplast fusion, electroporation, biolistics, liposomes, microinjection, plasma vectors, viral vectors (e.g., baculovirus, vaccinia virus, adenovirus and other viruses), and any other the other well known methods for introducing cloned genomic DNA, cDNA, plasmid DNA, cosmid DNA, synthetic DNA or other foreign genetic material into a host cell.

a. Prokaryotic Expression

Prokaryotes, especially *E. coli*, provide a system for producing large amounts of proteins and can be used to express the provided anti-RSV antibodies or antigen-binding fragments thereof. Typically, *E. coli* host cells are used for amplification and expression of the provided variant polypeptides. Transformation of *E. coli* is simple and rapid technique well known to those of skill in the art. Expression vectors for *E. coli* can contain inducible promoters, such promoters are useful for inducing high levels of protein expression and for expressing proteins that exhibit some toxicity to the host cells. Examples of inducible promoters include the lac promoter, the trp promoter, the hybrid tac promoter, the T7 and SP6 RNA promoters and the temperature regulated XPL promoter.

Proteins, such as any provided herein, can be expressed in the cytoplasmic environment of *E. coli*. For some polypeptides, the cytoplasmic environment, can result in the formation of insoluble inclusion bodies containing aggregates of the proteins. Reducing agents such as dithiothreitol and β-mercaptoethanol and denaturants, such as guanidine-HCl and urea can be used to resolubilize the proteins, followed by subsequent refolding of the soluble proteins. An alternative approach is the expression of proteins in the periplasmic space of bacteria which provides an oxidizing environment and chaperonin-like and disulfide isomerases and can lead to the production of soluble protein. For example, for phage display of the proteins, the proteins are exported to the periplasm so that they can be assembled into the phage. Typically, a leader sequence is fused to the protein to be expressed which directs the protein to the periplasm. The leader is then removed by signal peptidases inside the periplasm. Examples of periplasmic-targeting leader sequences include the pelB leader from the pectate lyase gene and the leader derived from the alkaline phosphatase gene. In some cases, periplasmic expression allows leakage of the expressed protein into the culture medium. The secretion of proteins allows quick and simple purification from the culture supernatant. Proteins that are not secreted can be obtained from the periplasm by osmotic lysis. Similar to cytoplasmic expression, in some cases proteins can become insoluble and denaturants and reducing agents can be used to facilitate solubilization and refolding. Temperature of induction and growth also can influence expression levels and solubility, typically temperatures between 25° C. and 37° C. are used. Typically, bacteria produce non-glycosylated proteins. Thus, if proteins require glycosylation for function, glycosylation can be added in vitro after purification from host cells.

b. Yeast Cells

Yeasts such as *Saccharomyces cerevisae, Schizosaccharomyces pombe, Yarrowia lipolytica, Kluyveromyces lactis* and *Pichia pastoris* are well known yeast expression hosts that can be used to express the anti-RSV antibodies or antigen-binding fragments thereof provided herein. Yeast can be transformed with episomal replicating vectors or by stable chromosomal integration by homologous recombination. Typically, inducible promoters are used to regulate gene expression. Examples of such promoters include GAL1, GAL7 and GAL5 and metallothionein promoters, such as CUP1, AOX1 or other *Pichia* or other yeast promoter. Expression vectors often include a selectable marker such as LEU2, TRP1, HIS3 and URA3 for selection and maintenance of the transformed DNA. Proteins expressed in yeast are often soluble. Co-expression with chaperonins such as Bip and protein disulfide isomerase can improve expression levels and solubility. Additionally, proteins expressed in yeast can be directed for secretion using secretion signal peptide fusions such as the yeast mating type alpha-factor secretion signal from *Saccharomyces cerevisae* and fusions with yeast cell surface proteins such as the Aga2p mating adhesion receptor or the *Arxula adeninivorans* glucoamylase. A protease cleavage site such as for the Kex-2 protease, can be engineered to remove the fused sequences from the expressed polypeptides as they exit the secretion pathway. Yeast also is capable of glycosylation at Asn-X-Ser/Thr motifs.

c. Insect Cells

Insect cells, particularly using baculovirus expression, can be used to express the anti-RSV antibodies or antigen-binding fragments thereof provided herein. Insect cells express high levels of protein and are capable of most of the post-translational modifications used by higher eukaryotes. Baculovirus have a restrictive host range which improves the safety and reduces regulatory concerns of eukaryotic expression. Typical expression vectors use a promoter for high level expression such as the polyhedrin promoter of baculovirus. Commonly used baculovirus systems include the baculoviruses such as *Autographa californica* nuclear polyhedrosis virus (AcNPV), and the *Bombyx mori* nuclear polyhedrosis virus (BmNPV) and an insect cell line such as Sf9 derived from *Spodoptera frugiperda, Pseudaletia unipuncta* (A7S) and *Danaus plexippus* (DpN 1). For high-level expression, the nucleotide sequence of the molecule to be expressed is fused immediately downstream of the polyhedrin initiation codon of the virus. Mammalian secretion signals are accurately processed in insect cells and can be used to secrete the expressed protein into the culture medium. In addition, the cell lines *Pseudaletia unipuncta* (A7S) and *Danaus plexippus* (DpN1) produce proteins with glycosylation patterns similar to mammalian cell systems.

An alternative expression system in insect cells is the use of stably transformed cells. Cell lines such as the Schnieder 2 (S2) and Kc cells (*Drosophila melanogaster*) and C7 cells (*Aedes albopictus*) can be used for expression. The *Drosophila metallothionein* promoter can be used to induce high levels of expression in the presence of heavy metal induction with cadmium or copper. Expression vectors are typically maintained by the use of selectable markers such as neomycin and hygromycin.

d. Mammalian Cells

Mammalian expression systems can be used to express the anti-RSV antibodies or antigen-binding fragments thereof provided herein. Expression constructs can be transferred to mammalian cells by viral infection, such as, but not limited to adenovirus or vaccinia virus, or by direct DNA transfer such as liposomes, calcium phosphate, DEAE-dextran and by physical means, such as electroporation and microinjection. Expression vectors for mammalian cells typically include an mRNA cap site, a TATA box, a translational initiation sequence (Kozak consensus sequence) and polyadenylation elements. Such vectors often include transcriptional promoter-enhancers for high-level expression, for example the SV40 promoter-enhancer, the human cytomegalovirus (CMV) promoter and the long terminal repeat of Rous sarcoma virus. These promoter-enhancers are active in many cell types. Tissue and cell-type promoters and enhancer regions also can be used for expression. Exemplary promoter/enhancer regions include, but are not limited to, those from genes such as elastase I, insulin, immunoglobulin, mouse mammary tumor virus, albumin, alpha fetoprotein, alpha 1 antitrypsin, beta globin, myelin basic protein, myosin light chain 2, and gonadotropic releasing hormone gene control. Selectable markers can be used to select for and maintain cells with the expression construct. Examples of selectable marker genes include, but are not limited to, hygromycin B phosphotransferase, adenosine deaminase, xanthine-guanine phosphoribosyl transferase, aminoglycoside phosphotransferase, dihydrofolate reductase and thymidine kinase. Fusion with cell surface signaling molecules such as TCR-ζ and $Fc_{\epsilon}RI$-γ can direct expression of the proteins in an active state on the cell surface.

Many cell lines are available for mammalian expression including mouse, rat human, monkey, chicken and hamster cells. Exemplary cell lines include, but are not limited to, CHO, Balb/3T3, BHK, HeLa, MDCK, MT2, mouse NS0 (nonsecreting) and other myeloma cell lines, hybridoma and heterohybridoma cell lines, lymphocytes, fibroblasts, Sp2/0, COS, NIH3T3, HEK293, W138, BT483, HS578T, HTB2, BT20, T47D, 293S, 2B8, and HKB cells. Cell lines also are available adapted to serum-free media which facilitates purification of secreted proteins from the cell culture media. One such example is the serum free EBNA-1 cell line (Pham et al., (2003) *Biotechnol. Bioeng.* 84:332-42.)

e. Plants

Transgenic plant cells and plants can be to express polypeptides such as any described herein. Expression constructs are typically transferred to plants using direct DNA transfer such as microprojectile bombardment and PEG-mediated transfer into protoplasts, and with agrobacterium-mediated transformation. Expression vectors can include promoter and enhancer sequences, transcriptional termination elements and translational control elements. Expression vectors and transformation techniques are usually divided between dicot hosts, such as *Arabidopsis* and tobacco, and monocot hosts, such as corn and rice. Examples of plant promoters used for expression include the cauliflower mosaic virus promoter, the nopaline syntase promoter, the ribose bisphosphate carboxylase promoter and the ubiquitin and UBQ3 promoters. Selectable markers such as hygromycin, phosphomannose isomerase and neomycin phosphotransferase are often used to facilitate selection and maintenance of transformed cells. Transformed plant cells can be maintained in culture as cells, aggregates (callus tissue) or regenerated into whole plants. Transgenic plant cells also can include algae engineered to produce proteases or modified proteases (see for example, Mayfield et al. (2003) *Proc Natl Acad Sci USA* 100:438-442). Because plants have different glycosylation patterns than mammalian cells, this can influence the choice of protein produced in these hosts.

4. Purification of Antibodies

Methods for purification of polypeptides, including the anti-RSV antibodies or antigen-binding fragments thereof provided herein, from host cells will depend on the chosen host cells and expression systems. For secreted molecules, proteins generally are purified from the culture media after removing the cells. For intracellular expression, cells can be lysed and the proteins purified from the extract. In one example, polypeptides are isolated from the host cells by centrifugation and cell lysis (e.g. by repeated freeze-thaw in a dry ice/ethanol bath), followed by centrifugation and retention of the supernatant containing the polypeptides. When transgenic organisms such as transgenic plants and animals are used for expression, tissues or organs can be used as starting material to make a lysed cell extract. Additionally, transgenic animal production can include the production of polypeptides in milk or eggs, which can be collected, and if necessary further the proteins can be extracted and further purified using standard methods in the art.

Proteins, such as the anti-RSV antibodies or antigen-binding fragments thereof provided herein, can be purified, for example, from lysed cell extracts, using standard protein purification techniques known in the art including but not limited to, SDS-PAGE, size fraction and size exclusion chromatography, ammonium sulfate precipitation and ionic exchange chromatography, such as anion exchange. Affinity purification techniques also can be utilized to improve the efficiency and purity of the preparations. For example, antibodies, receptors and other molecules that bind proteases can be used in affinity purification. Expression constructs also can be engineered to add an affinity tag to a protein such as a myc epitope, GST fusion or $His_6$ and affinity purified with myc antibody, glutathione resin and Ni-resin, respectively. Purity can be assessed by any method known in the art including gel electrophoresis and staining and spectrophotometric techniques.

The isolated polypeptides then can be analyzed, for example, by separation on a gel (e.g. SDS-Page gel), size fractionation (e.g. separation on a Sephacryl™ S-200 HiPrep™ 16×60 size exclusion column (Amersham from GE Healthcare Life Sciences, Piscataway, N.J.). Isolated polypeptides also can be analyzed in binding assays, typically binding assays using a binding partner bound to a solid support, for example, to a plate (e.g. ELISA-based binding assays) or a bead, to determine their ability to bind desired binding partners. The binding assays described in the sections below, which are used to assess binding of precipitated phage displaying the polypeptides, also can be used to assess polypeptides isolated directly from host cell lysates. For example, binding assays can be carried out to determine whether antibody polypeptides bind to one or more antigens, for example, by coating the antigen on a solid support, such as a well of an assay plate and incubating the isolated polypeptides on the solid support, followed by washing and detection with secondary reagents, e.g. enzyme-labeled antibodies and substrates.

G. ASSESSING ANTI-RSV ANTIBODY PROPERTIES AND ACTIVITIES

The anti-RSV antibodies or antigen-binding fragments thereof provided herein can be characterized in a variety of ways well-known to one of skill in the art. For example, the anti-RSV antibodies or antigen-binding fragments thereof provided herein can be assayed for the ability to immunospecifically bind to an F protein of human Respiratory Syncytial Virus (RSV). Such assays can be performed, for example, in solution (e.g., Houghten (1992) *Bio/Techniques* 13:412-421), on beads (Lam (1991) *Nature* 354:82-84), on chips (Fodor (1993) *Nature* 364:555-556), on bacteria (U.S. Pat. No. 5,223,409), on spores (U.S. Pat. Nos. 5,571,698; 5,403,484; and 5,223,409), on plasmids (Cull et al. (1992) *Proc. Natl. Acad. Sci. USA* 89:1865-1869) or on phage (Scott and Smith (1990) *Science* 249:386-390; Devlin (1990) *Science* 249:404-406; Cwirla et al. (1990) *Proc. Natl. Acad. Sci. USA* 87:6378-6382; and Felici (1991) *J. Mol. Biol.* 222:301-310). Antibodies or antigen-binding fragments thereof that have been identified to immunospecifically bind to a RSV antigen or a fragment thereof also can be assayed for their specificity and affinity for a RSV antigen. The binding specificity, or epitope, can be determined, for example, by competition assays with other anti-RSV antibodies and/or virus neutralization assays using Monoclonal Antibody-Resistant Mutants (MARMs). In addition, in vitro assays and in vivo animal models using the anti-RSV antibodies or antigen-binding fragments thereof provided herein can be employed for measuring the level of RSV neutralization effected by contact or administration of the anti-RSV antibodies or antigen-binding fragments thereof.

1. Binding Assays

The anti-RSV antibodies or antigen-binding fragments thereof provided herein can be assessed for their ability to bind a selected target (e.g., RSV virus or isolated RSV F protein) and the specificity for such targets by any method known to one of skill in the art. Exemplary assays are provided in Examples 5 and 8 below, and described herein below. Binding assays can be performed in solution, suspension or on a solid support. For example, target antigens can be immobilized to a solid support (e.g. a carbon or plastic surface, a tissue culture dish or chip) and contacted with antibody or antigen-binding fragment thereof. Unbound antibody or target protein can be washed away and bound complexes can then be detected. Binding assays can be performed under conditions to reduce nonspecific binding, such as by using a high ionic strength buffer (e.g., 0.3-0.4 M NaCl) with non-ionic detergent (e.g. 0.1% Triton X-100 or Tween 20) and/or blocking proteins (e.g. bovine serum albumin or gelatin). Negative controls also can be included in such assays as a measure of background binding. Binding affinities can be determined using Scatchard analysis (Munson et al., (1980) *Anal. Biochem.,* 107:220), surface plasmon resonance, isothermal calorimetry, or other methods known to one of skill in the art.

Exemplary immunoassays which can be used to analyze immunospecific binding and cross-reactivity include, but are not limited to, competitive and non-competitive assay systems using techniques such as, but not limited to, western blots, radioimmunoassays, ELISA (enzyme linked immunosorbent assay), Meso Scale Discovery (MSD, Gaithersburg, Md.), "sandwich" immunoassays, immunoprecipitation assays, ELISPOT, precipitin reactions, gel diffusion precipitin reactions, immunodiffusion assays, agglutination assays, complement-fixation assays, immunoradiometric assays, fluorescent immunoassays, protein A immunoassays. Such assays are routine and well known in the art (see, e.g., Ausubel et al, eds, 1994, Current Protocols in Molecular Biology, Vol. 1, John Wiley & Sons, Inc., New York, which is incorporated by reference herein in its entirety). Other assay formats include liposome immunoassays (LIA), which use liposomes designed to bind specific molecules (e.g., antibodies) and release encapsulated reagents or markers. The released chemicals are then detected according to standard techniques (see Monroe et al., (1986) *Amer. Clin. Prod. Rev.* 5:34-41). Exemplary immunoassays not intended by way of limitation are described briefly below.

Immunoprecipitation protocols generally involve lysing a population of cells in a lysis buffer such as RIPA buffer (1% NP-40 or Triton X-100, 1% sodium deoxycholate, 0.1% SDS, 0.15 M NaCl, 0.01 M sodium phosphate at pH 7.2, 1% Trasylol) supplemented with protein phosphatase and/or protease inhibitors (e.g., EDTA, PMSF, aprotinin, sodium vanadate), adding the antibody or antigen-binding fragment thereof of interest to the cell lysate, incubating for a period of time (e.g., 1 to 4 hours) at 40° C., adding protein A and/or protein G sepharose beads to the cell lysate, incubating for about an hour or more at 40° C., washing the beads in lysis buffer and resuspending the beads in SDS/sample buffer. The ability of the antibody or antigen-binding fragment thereof of interest to immunoprecipitate a particular antigen can be assessed by, e.g., western blot analysis. One of skill in the art is knowledgeable as to the parameters that can be modified to increase the binding of the antibody or antigen-binding fragment thereof to an antigen and decrease the background (e.g., pre-clearing the cell lysate with sepharose beads). For further discussion regarding immunoprecipitation protocols see, e.g., Ausubel et al., eds, 1994, Current Protocols in Molecular Biology, Vol. 1, John Wiley & Sons, Inc., New York at 10.16.1.

Western blot analysis generally involves preparing protein samples, electrophoresis of the protein samples in a polyacrylamide gel (e.g., 8%-20% SDS-PAGE depending on the molecular weight of the antigen), transferring the protein sample from the polyacrylamide gel to a membrane such as nitrocellulose, PVDF or nylon, blocking the membrane in blocking solution (e.g., PBS with 3% BSA or non-fat milk), washing the membrane in washing buffer (e.g., PBS-Tween 20), blocking the membrane with primary antibody or antigen-binding fragment thereof (i.e., the antibody or antigen-binding fragment thereof of interest) diluted in blocking buffer, washing the membrane in washing buffer, blocking the membrane with a secondary antibody (which recognizes the primary antibody, e.g., an anti-human antibody) conjugated to an enzymatic substrate (e.g., horseradish peroxidase or alkaline phosphatase) or radioactive molecule (e.g., $^{32}P$ or $^{125}I$) diluted in blocking buffer, washing the membrane in wash buffer, and detecting the presence of the antigen. One of skill in the art is knowledgeable as to the parameters that can be modified to increase the signal detected and to reduce the background noise. For further discussion regarding western blot protocols see, e.g., Ausubel et al, eds, 1994, Current Protocols in Molecular Biology, Vol. 1, John Wiley & Sons, Inc., New York at 10.8.1.

ELISAs involve preparing antigen, coating the well of a 96-well microtiter plate with the antigen, adding the antibody or antigen-binding fragment thereof of interest conjugated to a detectable compound such as an enzymatic substrate (e.g., horseradish peroxidase or alkaline phosphatase) to the well and incubating for a period of time, and detecting the presence of the antigen. In ELISAs, the antibody or antigen-binding fragment thereof of interest does not have to be conjugated to a detectable compound; instead, a second antibody (which recognizes the antibody of interest) conjugated to a detectable compound can be added to the well. Further, instead of coating the well with the antigen, the antibody can be coated to the well. In this case, a second antibody conjugated to a detectable compound can be added following the addition of the antigen of interest to the coated well. One of skill in the art is knowledgeable as to the parameters that can be modified to increase the signal detected as well as other variations of ELISAs known in the art. For further discussion regarding ELISAs see, e.g., Ausubel et al, eds, 1994, Current Protocols in Molecular Biology, Vol. 1, John Wiley & Sons, Inc., New York at 11.2.1. Examples 5 and 8 exemplify a binding assay for binding of anti-RSV antibodies to RSV F protein.

The binding affinity of an antibody or antigen-binding fragment thereof to an antigen and the off-rate of an antibody-antigen interaction can be determined, for example, by competitive binding assays. One example of a competitive binding assay is a radioimmunoassay comprising the incubation of labeled antigen (e.g., $^{3}H$ or $^{125}I$) with the antibody or antigen-binding fragment thereof of interest in the presence of increasing amounts of unlabeled antigen, and the detection of the antibody or antigen-binding fragment thereof bound to the labeled antigen. The affinity of an anti-RSV antibody or antigen-binding fragment thereof provided herein for a RSV antigen and the binding off-rates can be determined from the data by Scatchard plot analysis. Competition with a second antibody can also be determined using radioimmunoassays. In this case, a RSV antigen is incubated with an anti-RSV antibody or antigen-binding fragment thereof provided herein conjugated to a labeled compound (e.g., $^{3}H$ or $^{125}I$) in the presence of increasing amounts of an unlabeled second antibody. In some examples, surface plasmon resonance (e.g., BiaCore 2000, Biacore AB, Upsala, Sweden and GE Healthcare Life Sciences; Malmqvist (2000) *Biochem. Soc. Trans.* 27:335) kinetic analysis can be used to determine the binding on and off rates of antibodies or antigen-binding fragments thereof to a RSV antigen. Surface plasmon resonance kinetic analysis involves analyzing the binding and dissociation of a RSV antigen from chips with immobilized antibodies or fragments thereof on their surface.

The anti-RSV antibodies or antigen-binding fragments thereof provided herein also can be assayed for their ability to inhibit the binding of RSV to its host cell receptor using techniques known to those of skill in the art. For example, cells expressing the receptor for RSV can be contacted with RSV in the presence or absence of an antibody or antigen-binding fragment thereof and the ability of the antibody or fragment thereof to inhibit RSV's binding can measured by, for example, flow cytometry or a scintillation assay. RSV (e.g., a RSV antigen such as F glycoprotein or G glycoprotein) or the antibody or antibody fragment can be labeled with a detectable compound such as a radioactive label (e.g., $^{32}P$, $^{35}S$, and $^{125}I$) or a fluorescent label (e.g., fluorescein isothiocyanate, rhodamine, phycoerythrin, phycocyanin, allophycocyanin, o-phthaldehyde and fluorescamine) to enable detection of an interaction between RSV and its host cell receptor.

The ability of antibodies or antigen-binding fragments thereof to inhibit RSV from binding to its receptor also can be determined in cell-free assays. For example, RSV or a RSV antigen such as F glycoprotein can be contacted with an antibody or fragment thereof and the ability of the antibody or antibody fragment to inhibit RSV or the RSV antigen from binding to its host cell receptor can be determined. In some examples, the antibody or the antigen-binding fragment is immobilized on a solid support and RSV or a RSV antigen is labeled with a detectable compound. In some examples, RSV or a RSV antigen is immobilized on a solid support and the antibody or fragment thereof is labeled with a detectable compound. The RSV or RSV antigen can be partially or completely purified (e.g., partially or completely free of other polypeptides) or part of a cell lysate. In some examples, a RSV antigen can be a fusion protein comprising the RSV antigen and a domain such as glutathionine-S-transferase. In some examples, a RSV antigen can be biotinylated using techniques well known to those of skill in the art (e.g., biotinylation kit, Pierce Chemicals; Rockford, Ill.).

2. Binding Specificity

The binding specificity, or epitope, of the anti-RSV antibodies or antigen binding fragments thereof provided herein can be determined by any assay known to one of skill in the art, including, but not limited to surface plasmon resonance assays, competition assays and virus neutralization assays using Monoclonal Antibody-Resistant Mutants (MARMs). The epitope can be in the isolated protein, i.e., the isolated F protein, or in the protein in the virus. The ability of two antibodies to bind to the same epitope can be determined by known assays in the art such as, for example, surface plasmon resonance assays and antibody competition assays. Typically, antibodies that immunospecifically bind to the same epitope can compete for binding to the epitope, which can be measured, for example, by an in vitro binding competition assay (e.g. competition ELISA), using techniques known the art. Typically, a first antibody that immunospecifically binds to the same epitope as a second antibody can compete for binding to the epitope by about or 30%, 35%, 40%, 45%, 50%, 55%, 60%, 65%, 70%, 75%, 80%, 85%, 90%, 95%, 100%, where the percentage competition is measured ability of the second antibody to displace binding of the first antibody to the epitope. In exemplary competition assays, the antigen is incubated in the presence a predetermined limiting dilution of a labeled antibody (e.g., 50-70% saturation concentration), and serial dilutions of an unlabeled competing antibody. Competition is determined by measuring the binding of the labeled antibody to the antigen for any decreases in binding in the presence of the competing antibody. Variations of such assays, including various labeling techniques and detection methods including, for example, radiometric, fluorescent, enzymatic and colorimetric detection, are known in the art. For example, as is exemplified in Example 10 below, antibody IgG 58c5 and motavizumab do not compete for binding to RSV F protein, thus indicating that antibody IgG 58c5 binds a different epitope than motavizumab.

The ability of a first antibody to bind to the same epitope as a second antibody also can be determined, for example, by virus neutralization assays using Monoclonal Antibody-Resistant Mutants. A MARM is a mutant respiratory syncytial virus (RSV) that not neutralized by a monoclonal antibody that neutralizes the wildtype RSV virus, i.e., a MARM is an RSV escape mutant. MARMs are generated by culturing wildtype RSV in the presence of a monoclonal antibody for successive rounds of viral replication in the presence of the antibody such that after each successive round of virus replication, cytopathic effects (CPE) are observed in the presence of increasing concentrations of antibodies until a mutant virus results that is not neutralized by the antibody. If a first antibody can neutralize a MARM generated against a second antibody, one can conclude that the antibodies specifically bind to or interact with different epitopes. For example, where a first anti-RSV antibody neutralizes wild-type RSV but not a particular mutant RSV (i.e., MARM), a second antibody that neutralizes the wild-type RSV but not the particular mutant RSV generally binds the same epitope on RSV as the first antibody. Where a first anti-RSV antibody neutralizes wild-type RSV but not a particular mutant RSV, a second antibody that neutralizes the wild-type RSV and the particular mutant RSV generally does not bind the same epitope on RSV as the first antibody.

For example, as is exemplified in Example 9 below, IgG 58c5 provided herein is capable of neutralizing MARMs previously generated against various anti-RSV antibodies, including MARM 1129, generated against MAb 1129, the parental antibody to palivizumab and motavizumab (see, Johnson et al. (1997) *J. Infect. Diseases* 176:1215-1224 and U.S. Pat. No. 5,824,307), MARM 19, generated against Fab 19 (see Barbas et al. (1992) *Proc. Natl. Acad. Sci. USA* 89:10164-10168) and MARM 151, generated against MAb 151 (see, Mufson et al., (1985) *J. Gen. Virol,* 66:2111-2124). Thus, IgG 58c5 binds a different epitope on the F protein then antibodies Fab 19, MAb 151 and MAb 1129.

As is exemplified in Example 11 below, MARMs were generated against motavizumab and IgG 58c5. The motavizumab MARM, generated after 5-7 rounds of selection, contains a single amino acid mutation (K272E, SEQ ID NO:1642) compared to the wildtype RSV F protein. Mutation at amino acid K272 is consistant with known mutations that disrupt binding of the parent antibody of motavizumab (see, Zhao et al., (2004) *J. Infectious Disease* 190:1941-1946). The IgG 58c5 MARM, generated after 10 rounds of selection, contains 3 amino acid mutations (N63K, M115K and E295G, SEQ ID NO:1643) compared to the wildtype RSV F protein. The mutations effecting escape in the IgG 58c5 MARM have not been previously identified as antigenic sites for various monoclonal antibodies that immunospecifically bind to the RSV F protein (see, e.g., Beeler et al. (1989) *J. Virology* 63(7):2841-2950, Crowe et al. (1998) *Virology* 252:373-375; Zhao et al., (2004) *J. Infectious Disease* 190:1941-1946; Liu et al., (2007) *Virology Journal* 4:71). Additionally, as is shown in Example 11 below, IgG 58c5 neutralizes the motavizumab MARM, and motavizumab neutralizes the IgG 58c5 MARM. Thus, IgG 58c5 binds a different epitope of the RSV F protein than motavizumab.

3. In vitro Assays for Analyzing Virus Neutralization Effects of Antibodies

The anti-RSV antibodies or antigen-binding fragments thereof provided herein can be analyzed by any suitable method known in the art for the detection of viral neutralization. Methods for detection of viral neutralization include, but are not limited to, plaque assays and assays for inhibition of syncytium formation. Such assays can be employed to assess, for example, inhibition of viral attachment, viral entry and cell-to-cell spread of the virus (see, e.g. Burioni et al., (1994) *Proc. Natl. Acad. Sci. U.S.A.* 91:355-359; Sanna et al. (2000) *Virology* 270:386-3961; and De Logu et al., (1998) *J Clin Microbiol* 36:3198-3204). One of skill in the art can identify any assay capable of measuring viral neutralization.

Standard plaque assays include, for example, plaque reduction assays, plaque size reduction assays, neutralization assays and neutralization kinetic assays. These assays measure the formation of viral plaques (i.e. areas of lysed cells) following infection of target cell monolayers by a virus. Exemplary target cell lines that can be used in plaque reduction assays include, but are not limited to, Vero cells, MRC-5 cells, RC-37 cells, BHK-21/C13 cells and HEp-2 cells. One of skill in the art can identify appropriate target cell lines for use in a plaque assay. Selection of an appropriate cell line for a plaque assay can depend on known factors, such as, for example, cell infectivity and the ability of the virus to propagate in and lyse the target cell. Examples 6 and 9 exemplify in vitro neutralization assays.

Plaque reduction assays can be used to measure the ability of the anti-RSV antibody or antigen-binding fragment thereof to effect viral neutralization in solution. In exemplary plaque reduction assays, the antibody or antigen-binding fragment thereof and the virus are pre-incubated prior to the addition of target cells. Target cells are then infected with the antibody/virus mixture and a plaque assay is performed following a predetermined infection period. One of skill in the art can determine the incubation times required based on known examples in the art. A reduction in the number of virus plaques produced following infection of the target cells indicates the ability of the antibody or antigen-binding fragment thereof to prevent binding of the virus to the target cells independent of antibody or antigen-binding fragment thereof attachment to the target cell and/or antibody, or antigen-binding fragment thereof, internalization.

Plaque size reduction assays can be used to measure the ability of the anti-RSV antibody or antigen-binding fragment thereof to inhibit of viral cell-to-cell spread. In exemplary plaque size reduction assays, the target cells are first infected with the virus for a predetermined infection period and then the antibody or antigen-binding fragment thereof is added to the infected cell. One of skill in the art can determine the incubation times required based on known examples in the art. A reduction in the size (i.e. diameter) of the virus plaques indicates that the antibody or antigen-binding fragment thereof is capable of preventing viral cell-to-cell spread.

Virus neutralization assays can be used to measure the ability of the anti-RSV antibody or antigen-binding fragment thereof to effect viral neutralization at the target cell surface by association of the antibody or antigen-binding fragment thereof with the target cell prior to virus exposure. In exemplary virus neutralization assays, the antibody or antigen-binding fragment thereof and target cells are pre-incubated for a predetermined period of time to allow for binding of the antibody or antigen-binding fragment thereof to the targeted cell. Following the pre-incubation period, the unbound antibody is removed and the target cells are infected with the virus. A reduction in the number of plaques in this assay indicates the ability of the antibody or antigen-binding fragment thereof to prevent viral infection dependent upon attachment to the target cell and/or internalization of the antibody or antigen-binding fragment thereof. This assay also can be used to measure neutralization kinetics by varying antibody or antigen-binding fragment concentrations and pre-incubation times.

Exemplary assays for inhibition of syncytium formation can be employed to measure antibody-mediated inhibition of viral cytopathic effects by blocking the formation of syncytia when using a fusogenic viral strain. One of skill in the art can identify an appropriate fusogenic viral strain for use in the assay.

The anti-RSV antibodies or antigen-binding fragments thereof provided herein also can be assayed for their ability to inhibit or downregulate RSV replication using techniques known to those of skill in the art. For example, RSV replication can be assayed by a plaque assay such as described, e.g., by Johnson et al. (1997) *Journal of Infectious Diseases* 176:1215-1224. The anti-RSV antibodies or antigen-binding fragments thereof provided herein also can be assayed for their ability to inhibit or downregulate the expression of RSV polypeptides. Techniques known to those of skill in the art, including, but not limited to, Western blot analysis, Northern blot analysis, and RT-PCR can be used to measure the expression of RSV polypeptides.

4. In Vivo Animal Models for Assessing Efficacy of the Anti-RSV Antibodies

In vivo studies using animal models can be performed to assess the efficacy of the anti-RSV antibodies or antigen-binding fragments thereof provided herein. In vivo studies using animal models can be performed to assess any toxicity of administration of such antibodies or antigen-binding fragments thereof. A variety of assays, such as those employing in vivo animal models, are available to those of skill in the art for evaluating the ability of the anti-RSV antibodies to inhibit or treat RSV virus infection and for assaying any toxicity. The therapeutic effect of the anti-RSV antibodies can be assessed using animal models of the pathogenic infection, including animal models of viral infection. Such animal models are known in the art, and include, but are not limited to, animal models for RSV infection, such as but not limited to cotton rat, inbred mouse, calf, ferret, hamster, guinea pig, chimpanzee, owl monkey, rhesus monkey, African green monkey, cebus monkey, squirrel monkey, bonnet monkey, baboon, (see, e.g., Prince et al. (1978) *Am. J. Pathol.* 93:771-791; Prince et al. (1979) *Infect. Immunol.* 26:764-766; Byrd and Prince (1997) Clinical Infectious Diseases 25:1363-1368, including references cited therein, for exemplary models of RSV infection). For in vivo testing of an antibody or antigen-binding fragment or composition's toxicity, any animal model system known in the art can be used, including, but not limited to, rats, mice, cows, monkeys, and rabbits.

5. In Vitro and In Vivo Assays for Measuring Antibody Efficacy

Efficacy in treating or preventing viral infection can be demonstrated by detecting the ability of a anti-RSV antibody or antigen-binding fragment thereof provided herein to inhibit the replication of the virus, to inhibit transmission or prevent the virus from establishing itself in its host, to reduce the incidence of RSV infection, or to prevent, ameliorate or alleviate one or more symptoms associated with RSV infection. The treatment is considered therapeutic if there is, for example, a reduction is viral load, amelioration of one or more symptoms, a reduction in the duration of a RSV infection, or a decrease in mortality and/or morbidity following administration of an antibody or composition provided herein. Further, the treatment is considered therapeutic if there is an increase in the immune response following the administration of one or more antibodies or antigen-binding fragments thereof which immunospecifically bind to one or more RSV antigens.

The anti-RSV antibodies or antigen-binding fragments thereof provided herein can be tested in vitro and in vivo for the ability to induce the expression of cytokines such as IFN-α, IFN-β, IFN-γ, IL-2, IL-3, IL-4, IL-5, IL-6, IL-7, IL-8, IL-9, IL-10, IL-12 and IL-15. Techniques known to those of skill in the art can be used to measure the level of expression of cytokines. For example, the level of expression of cytokines can be measured by analyzing the level of RNA of cytokines by, for example, RT-PCR and Northern blot analysis, and by analyzing the level of cytokines by, for example, immunoprecipitation followed by Western blot analysis or ELISA.

The anti-RSV antibodies or antigen-binding fragments thereof provided herein can be tested in vitro and in vivo for their ability to modulate the biological activity of immune cells, including human immune cells (e.g., T-cells, B-cells, and Natural Killer cells). The ability of an anti-RSV antibody or antigen-binding fragment to modulate the biological activity of immune cells can be assessed by detecting the expression of antigens, detecting the proliferation of immune cells, detecting the activation of signaling molecules, detecting the effector function of immune cells, or detecting the differentiation of immune cells. Techniques known to those of skill in the art can be used for measuring these activities. For example, cellular proliferation can be assayed by $^{3}$H-thymidine incorporation assays and trypan blue cell counts. Antigen expression can be assayed, for example, by immunoassays including, but are not limited to, competitive and non-competitive assay systems using techniques such as western blots, immunohistochemistry radioimmunoassays, ELISA (enzyme linked immunosorbent assay), "sandwich" immunoassays, immunoprecipitation assays, precipitin reactions, gel diffusion precipitin reactions, immunodiffusion assays, agglutination assays, complement-fixation assays, immunoradiometric assays, fluorescent immunoassays, protein A immunoassays and FACS analysis. The activation of signaling molecules can be assayed, for example, by kinase assays and electrophoretic shift assays (EMSAs).

The anti-RSV antibodies or antigen-binding fragments thereof provided herein also can be tested for their ability to inhibit viral replication or reduce viral load in in vitro, ex vivo and in vivo assays. The anti-RSV antibodies or antigen-binding fragments thereof also can be assayed for their ability to decrease the time course of RSV infection. The anti-RSV antibodies or antigen-binding fragments thereof also can be assayed for their ability to increase the survival period of humans suffering from RSV infection by at least or about 25%, at least or about 50%, at least or about 60%, at least or about 75%, at least or about 85%, at least or about 95%, or at least or about 99%. Further, anti-RSV antibodies or antigen-binding fragments thereof can be assayed for their ability reduce the hospitalization period of humans suffering from RSV infection by at least or about 60%, at least or about 75%, at least or about 85%, at least or about 95%, or at least or about 99%. Techniques known to those of skill in the art can be used to analyze the function of the anti-RSV antibodies or antigen-binding fragments thereof provided herein in vivo.

In accordance with the methods and uses provided herein, clinical trials with human subjects need not be performed in order to demonstrate the prophylactic and/or therapeutic efficacy of the anti-RSV antibodies or antigen-binding fragments thereof provided herein. In vitro and animal model studies using the anti-RSV antibodies or antigen-binding fragments thereof provided herein can be extrapolated to humans and are sufficient for demonstrating the prophylactic and/or therapeutic utility of the anti-RSV antibodies or antigen-binding fragments.

H. DIAGNOSTIC USES

The anti-RSV antibodies or antigen-binding fragments thereof provided herein can be used in diagnostic assays for the detection, purification, and/or neutralization of RSV. Exemplary diagnostic assays include in vitro and in vivo detection of RSV. For example, assays using the anti-RSV antibodies or antigen-binding fragments thereof provided herein for qualitatively and quantitatively measuring levels of RSV in an isolated biological sample (e.g., sputum) or in vivo are provided.

As described herein, the anti-RSV antibodies or antigen-binding fragments thereof can be conjugated to a detectable moiety for in vitro or in vivo detection. Such antibodies can be employed, for example, to evaluate the localization and/or persistence of the anti-RSV antibody or antigen-binding fragment thereof at an in vivo site, such as, for example, a mucosal site. The anti-RSV antibodies or antigen-binding fragments thereof which are coupled to a detectable moiety can be detected in vivo by any suitable method known in the art. The anti-RSV antibodies or antigen-binding fragments thereof which are coupled to a detectable moiety also can be detected in isolated biological samples, such as tissue or fluid samples obtained from the subject following administration of the antibody or antigen-binding fragment thereof 1. In Vitro Detection of Pathogenic Infection In general, RSV can be detected in a subject or patient based on the presence of one or more RSV proteins and/or polynucleotides encoding such proteins in a biological sample (e.g., blood, sera, sputum urine and/or other appropriate cells or tissues) obtained from a subject or patient. Such proteins can be used as markers to indicate the presence or absence of RSV in a subject or patient. The anti-RSV antibodies or antigen-binding fragments thereof provided herein can be employed for detection of the level of antigen and/or epitope that binds to the agent in the biological sample.

A variety of assay formats are known to those of ordinary skill in the art for using a anti-RSV antibody or antigen-binding fragment thereof to detect polypeptide markers in a sample (see, e.g., Harlow and Lane, Antibodies: A Laboratory Manual, Cold Spring Harbor Laboratory, 1988). In general, the presence or absence of RSV in a subject or patient can be determined by contacting a biological sample obtained from a subject or patient with an anti-RSV antibody or antigen-binding fragment thereof provided herein and detecting in the sample a level of polypeptide that binds to the anti-RSV antibody or antigen-binding fragment thereof In some examples, the assay involves the use of an anti-RSV antibody or antigen-binding fragment thereof provided herein immobilized on a solid support to bind to and remove the target polypeptide from the remainder of the sample. The bound polypeptide can then be detected using a detection reagent that contains a reporter group and specifically binds to the antibody/polypeptide complex. Such detection reagents can contain, for example, a binding agent that specifically binds to the polypeptide or an antibody or other agent that specifically binds to the binding agent.

In some examples, a competitive assay can be utilized, in which a polypeptide is labeled with a reporter group and allowed to bind to the immobilized anti-RSV antibody or antigen-binding fragment thereof after incubation of the anti-RSV antibody or antigen-binding fragment thereof with the sample. The extent to which components of the sample inhibit the binding of the labeled polypeptide to the anti-RSV antibody or antigen-binding fragment thereof is indicative of the reactivity of the sample with the immobilized anti-RSV antibody or antigen-binding fragment thereof Suitable polypeptides for use within such assays include full length RSV F proteins and portions thereof, including the extracellular domain of a RSV F protein, to which an anti-RSV antibody or antigen-binding fragment thereof binds, as described above.

The solid support can be any material known to those of ordinary skill in the art to which the protein can be attached. For example, the solid support can be a test well in a microtiter plate or a nitrocellulose or other suitable membrane. The support also can be a bead or disc, such as glass, fiberglass, latex or a plastic material such as polystyrene or polyvinylchloride. The support also can be a magnetic particle or a fiber optic sensor, such as those disclosed, for example, in U.S. Pat. No. 5,359,681. The anti-RSV antibody or antigen-binding fragment thereof can be immobilized on the solid support using a variety of techniques known to those of skill in the art. The anti-RSV antibody or antigen-binding fragment thereof can be immobilized by adsorption to a well in a microtiter plate or to a membrane. In such cases, adsorption can be achieved by contacting the anti-RSV antibody or antigen-binding fragment thereof, in a suitable buffer, with the solid support for a suitable amount of time. The contact time varies with temperature, but is typically between about 1 hour and about 1 day. In general, contacting a well of a plastic microtiter plate (such as polystyrene or polyvinylchloride) with an amount of anti-RSV antibody or antigen-binding fragment thereof ranging from about 10 ng to about 10 μg, and typically about 100 ng to about 1 μg, is sufficient to immobilize an adequate amount of anti-RSV antibody or antigen-binding fragment thereof.

Covalent attachment of anti-RSV antibody or antigen-binding fragment thereof to a solid support can generally be achieved by first reacting the support with a bifunctional reagent that will react with the support and a functional group, such as a hydroxyl or amino group, on the anti-RSV antibody or antigen-binding fragment thereof. For example, the anti-RSV antibody or antigen-binding fragment thereof can be covalently attached to supports having an appropriate polymer coating using benzoquinone or by condensation of an aldehyde group on the support with an amine and an active hydrogen on the binding partner (see, e.g., Pierce Immunotechnology Catalog and Handbook, 1991, at A12-A13).

In some examples, the assay is performed in a flow-through or strip test format, wherein the anti-RSV antibody or antigen-binding fragment thereof is immobilized on a membrane, such as nitrocellulose. In the flow-through test, polypeptides within the sample bind to the immobilized anti-RSV antibody or antigen-binding fragment thereof as the sample passes through the membrane. A second, labeled binding agent then binds to the anti-RSV antibody or antigen-binding fragment thereof-polypeptide complex as a solution containing the second binding agent flows through the membrane.

Additional assay protocols exist in the art that are suitable for use with the RSV proteins or anti-RSV antibodies or antigen-binding fragments thereof provided. The above descriptions are intended to be exemplary only. For example, it will be apparent to those of ordinary skill in the art that the above protocols can be readily modified to use RSV polypeptides to detect antibodies that bind to such polypeptides in a biological sample. The detection of such protein-specific antibodies can allow for the identification of RSV infection.

To improve sensitivity, multiple RSV protein markers can be assayed within a given sample. It will be apparent that anti-RSV antibodies or antigen-binding fragments thereof specific for different RSV polypeptides can be combined within a single assay. Further, multiple primers or probes can be used concurrently. The selection of RSV protein markers can be based on routine experiments to determine combinations that results in optimal sensitivity. In addition, or alternatively, assays for RSV proteins provided herein can be combined with assays for other known RSV antigens.

2. In Vivo Detection of Pathogenic Infection

The anti-RSV antibodies or antigen-binding fragments thereof provided herein can be employed as an in vivo diagnostic agent. For example, the anti-RSV antibodies or antigen-binding fragments thereof can provide an image of infected tissues (e.g., RSV infection in the lungs) using detection methods such as, for example, magnetic resonance imaging, X-ray imaging, computerized emission tomography and other imaging technologies. For the imaging of RSV infected tissues, for example, the antibody portion of the anti-RSV antibody generally will bind to RSV (e.g., binding a RSV F protein epitope), and the imaging agent will be an agent detectable upon imaging, such as a paramagnetic, radioactive or fluorescent agent that is coupled to the anti-RSV antibody or antigen-binding fragment thereof. Generally, for use as a diagnostic agent, the anti-RSV antibody or antigen-binding fragment thereof is coupled directly or indirectly to the imaging agent.

Many appropriate imaging agents are known in the art, as are methods for their attachment to the anti-RSV antibodies or antigen-binding fragments (see, e.g., U.S. Pat. Nos. 5,021,236 and 4,472,509). Exemplary attachment methods involve the use of a metal chelate complex employing, for example, an organic chelating agent such a DTPA attached to the antibody or antigen-binding fragment thereof (U.S. Pat. No. 4,472,509). The antibodies also can be reacted with an enzyme in the presence of a coupling agent such as glutaraldehyde or periodate. Conjugates with fluorescein markers are prepared in the presence of such coupling agents or by reaction with an isothiocyanate.

For in vivo diagnostic imaging, the type of detection instrument available is considered when selecting a given radioisotope. The radioisotope selected has a type of decay which is detectable for a given type of instrument. Another factor in selecting a radioisotope for in vivo diagnosis is that the half-life of the radioisotope be long enough so that it is still detectable at the time of maximum uptake by the target, but short enough so that deleterious radiation with respect to the host is minimized. Typically, a radioisotope used for in vivo imaging will lack a particle emission, but produce a large number of photons in the 140-250 keV range, which can be readily detected by conventional gamma cameras.

For in vivo diagnosis, radioisotopes can be bound to the antibodies or antigen-binding fragments thereof provided herein either directly or indirectly by using an intermediate functional group. Exemplary intermediate functional groups which can be used to bind radioisotopes, which exist as metallic ions, to antibodies include bifunctional chelating agents, such as diethylene-riaminepentaacetic acid (DTPA) and ethylenediaminetetraacetic acid (EDTA) and similar molecules. Examples of metallic ions which can be bound to the anti-RSV antibodies or antigen-binding fragments thereof provided include, but are not limited to, $^{72}$Arsenic, $^{211}$Astatine, $^{14}$Carbon, $^{51}$Chromium, $^{36}$Chlorine, $^{57}$Cobalt, $^{58}$Cobalt, $^{67}$Copper, $^{152}$Europium, $^{67}$Gallium, $^{68}$Gallium, $^{3}$Hydrogen, $^{123}$Iodine, $^{125}$Iodine, $^{131}$Iodine, $^{111}$Indium, $^{59}$Iron, $^{32}$Phosphorus, $^{186}$Rhenium, $^{188}$Rhenium, $^{97}$Ruthenium, $^{75}$Selenium, $^{35}$Sulphur, $^{99m}$Technicium, $^{201}$Thalium, $^{90}$Yttrium and $^{89}$Zirconium.

The anti-RSV antibodies or antigen-binding fragments thereof provided herein can be labeled with a paramagnetic isotope for purposes of in vivo diagnosis, as in magnetic resonance imaging (MRI) or electron spin resonance (ESR). In general, any conventional method for visualizing diagnostic imaging can be utilized. Generally, gamma and positron emitting radioisotopes are used for camera imaging and paramagnetic isotopes for MRI. Elements which are particularly useful in such techniques include, but are not limited to, $^{157}$Gd, $^{55}$Mn, $^{162}$Dy, $^{52}$Cr, and $^{56}$Fe.

Exemplary paramagnetic ions include, but are not limited to, chromium (III), manganese (II), iron (III), iron (II), cobalt (II), nickel (II), copper (II), neodymium (III), samarium (III), ytterbium (III), gadolinium (III), vanadium (II), terbium (III), dysprosium (III), holmium (III) and erbium (III). Ions useful, for example, in X-ray imaging, include but are not limited to lanthanum (III), gold (III), lead (II), and bismuth (III).

The concentration of detectably labeled anti-RSV antibody or antigen-binding fragment thereof which is administered is sufficient such that the binding to RSV is detectable compared to the background. Further, it is desirable that the detectably labeled anti-RSV antibody or antigen-binding fragment thereof be rapidly cleared from the circulatory system in order to give the best target-to-background signal ratio.

The dosage of detectably labeled anti-RSV antibody or antigen-binding fragment thereof for in vivo diagnosis will vary depending on such factors as age, sex, and extent of disease of the individual. The dosage of a human monoclonal antibody can vary, for example, from about 0.01 mg/m$^2$ to about 500 mg/m$^2$, 0.1 mg/m$^2$ to about 200 mg/m$^2$, or about 0.1 mg/m$^2$ to about 10 mg/m$^2$. Such dosages can vary, for example, depending on whether multiple injections are given, tissue, and other factors known to those of skill in the art.

3. Monitoring Infection

The anti-RSV antibodies or antigen-binding fragments thereof provided herein can be used in vitro and in vivo to monitor the course of pathogenic disease therapy. Thus, for example, the increase or decrease in the number of cells infected with RSV or changes in the concentration of the RSV virus particles present in the body or in various body fluids can be measured. Using such methods, the anti-RSV antibodies or antigen-binding fragments thereof can be employed to determine whether a particular therapeutic regimen aimed at ameliorating the pathogenic disease is effective.

I. PROPHYLACTIC AND THERAPEUTIC USES

The anti-RSV antibodies or antigen-binding fragments thereof provided herein and pharmaceutical compositions containing anti-RSV antibodies or antigen-binding fragments thereof provided herein can be administered to a subject for prophylaxis and therapy. For example, the antibodies or antigen-binding fragments thereof provided can be administered for treatment of a disease or condition, such as a RSV infection. In some examples, the antibodies or antigen-binding fragments thereof provided can be administered to a subject for prophylactic uses, such as the prevention and/or spread of RSV infection, including, but not limited to the inhibition of establishment of RSV infection in a host or inhibition of RSV transmission between subjects. In some examples, the antibodies or antigen-binding fragments thereof provided can be administered to a subject for the reduction of RSV viral load in the subject. The antibodies or antigen-binding fragments thereof also can be administered to a subject for preventing, treating, and/or alleviating of one or more symptoms of a RSV infection or reduce the duration of a RSV infection.

In some examples, administration of an anti-RSV antibody or antigen-binding fragment thereof provided herein inhibits the incidence of RSV infection by at least or about 99%, at least or about 95%, at least or about 90%, at least or about 85%, at least or about 80%, at least or about 75%, at least or about 70%, at least or about 65%, at least or about 60%, at least or about 55%, at least or about 50%, at least or about 45%, at least or about 40%, at least or about 35%, at least or about 30%, at least or about 25%, at least or about 20%, at least or about 15%, or at least or about 10% relative to the incidence of RSV infection in the absence of the anti-RSV antibody or antigen-binding fragment. In some examples, administration of an anti-RSV antibody or antigen-binding fragment provided herein decreases the severity of one or more symptoms of RSV infection by at least or about 99%, at least or about 95%, at least or about 90%, at least or about 85%, at least or about 80%, at least or about 75%, at least or about 70%, at least or about 65%, at least or about 60%, at least or about 55%, at least or about 50%, at least or about 45%, at least or about 40%, at least or about 35%, at least or about 30%, at least or about 25%, at least or about 20%, at least or about 15%, or at least or about 10% relative to the severity of the one or more symptoms of RSV infection in the absence of the anti-RSV antibody or antigen-binding fragment.

1. Subjects for Therapy

A subject or candidate for therapy with an anti-RSV antibody or antigen-binding fragment thereof provided herein includes, but is not limited to, a subject, such as a human patient, that has been exposed to a RSV virus, a subject, such as a human patient, who exhibits one or more symptoms of a RSV infection and a subject, such as a human patient, who is at risk of a RSV infection. Exemplary RSV virus infections include those caused by RSV viruses, such as, but not limited to, acute RSV disease, RSV upper respiratory tract infection (URI) and/or RSV lower respiratory tract infection (LRI), including, for example, bronchiolitis and pneumonia.

In some examples, the subject for therapy with an anti-RSV antibody or antigen-binding fragment thereof provided herein is a mammal. In some examples, the subject for therapy with an anti-RSV antibody or antigen-binding fragment thereof provided herein is a primate. In particular examples, the subject for therapy with an anti-RSV antibody or antigen-binding fragment thereof provided herein is a human.

The provided anti-RSV antibodies or antigen-binding fragments thereof can be administered to a subject, such as a human patient, for the treatment of any RSV-mediated disease. For example, the anti-RSV antibodies or antigen-binding fragments thereof provided herein can be administered to a subject to alleviate one or more symptoms or conditions associated with a RSV virus infection, including, but not limited to, asthma, wheezing, reactive airway disease (RAD), and chronic obstructive pulmonary disease (COPD). Such diseases and condition are well known and readily diagnosed by physicians or ordinary skill.

The anti-RSV antibodies or antigen-binding fragments thereof provided herein can be administered to a subject, such a human patient, having a RSV virus infection for the maintenance or suppression therapy of recurring RSV virus-mediated disease.

The provided anti-RSV antibodies or antigen-binding fragments thereof can be administered to a subject, such as a human patient, at risk of a RSV virus infection, including, but not limited to, a prematurely born (pre-term) infant (e.g., a human infant born less than 38 weeks of gestational age, such as, for example, 29 weeks, 30 weeks, 31 weeks, 32 weeks, 33 weeks, 34 weeks, 35 weeks, 36 weeks, or 37 weeks gestational age); an infant (e.g., a human infant born more than 37 weeks gestational age), a subject having cystic fibrosis, bronchopulmonary dysplasia, congenital heart disease, congenital immunodeficiency, or acquired immunodeficiency (e.g., an AIDS patient), leukemia, non-Hodgkin lymphoma, an immunosuppressed patient, such as, for example, a recipient of a transplant (e.g. a bone marrow transplant or a kidney transplant), or elderly subjects, including individuals in nursing homes or rehabilitation centers. In some examples, the anti-RSV antibodies or antigen-binding fragments thereof provided herein can be administered to a subject, such as a pre-term infant or infant exposed to one or more environmental risk factors, such as, but not limited to attending daycare, having school aged siblings, exposure to environmental air pollutants, congenital airway abnormalities, and/or severe neuromuscular disease. In some examples, the provided anti-RSV antibodies or antigen-binding fragments thereof can be administered to a subject, such an infant or child who is younger than two years, having chronic lung disease or congenital heart disease, including congestive heart failure, pulmonary hypertension, and cyanotic heart disease.

Tests for various pathogens and pathogenic infection are known in the art and can be employed for the assessing whether a subject is a candidate for therapy with an anti-RSV antibody or antigen-binding fragment thereof provided herein. For example, tests for RSV virus infection, are known and include for example, viral culture plaque assays, antigen detection test, polymerase chain reaction (PCR) tests, and various antibody serological tests. Tests for viral infection can be performed on samples obtained from tissue or fluid samples, such as spinal fluid, blood, or urine. Additional tests include, but are not limited to chest X-rays, which can show signs of pneumonia, other blood tests, such as a chemistry screening, a complete blood count, or arterial blood gases (ABGs) analysis, and oximetry, to measure the amount of oxygen in the blood.

The anti-RSV antibodies or antigen-binding fragments thereof provided herein can be administered to a subject, who is at an increased risk of RSV infection during particular times of the year. RSV season typically extends from October through May. Subjects, who exhibit increased susceptibility to virus infection during this time, such as infants the elderly or immunocompromised patients, can be administered an anti-RSV antibody or antigen-binding fragment thereof provided herein for the prophylaxis and/or treatment of RSV infection just prior to and/or during RSV season. In some examples, the anti-RSV antibody or antigen-binding fragment thereof provided herein is administered one time, two times, three times, four times or five times during RSV season. In some examples, the anti-RSV antibody or antigen-binding fragment thereof provided herein is administered one time, two times, three times, four times or five times within one month, two months or three months, prior to a RSV season.

2. Dosages

The anti-RSV antibody or antigen-binding fragment thereof provided herein is administered in an amount sufficient to exert a therapeutically useful effect in the absence of undesirable side effects on the patient treated. The therapeutically effective concentration of an anti-RSV antibody or antigen-binding fragment thereof can be determined empirically by testing the polypeptides in known in vitro and in vivo systems such as by using the assays provided herein or known in the art.

An effective amount of antibody or antigen-binding fragment thereof to be administered therapeutically will depend, for example, upon the therapeutic objectives, the route of administration, and the condition of the patient. In addition, the attending physician takes into consideration various factors known to modify the action of drugs, including severity and type of disease, patient's health, body weight, sex, diet, time and route of administration, other medications and other relevant clinical factors. Accordingly, it will be necessary for the therapist to titer the dosage of the antibody or antigen-binding fragment thereof and modify the route of administration as required to obtain the optimal therapeutic effect. Typically, the clinician will administer the antibody or antigen-binding fragment thereof until a dosage is reached that achieves the desired effect. The progress of this therapy is easily monitored by conventional assays. Exemplary assays for monitoring treatment of a viral infection are know in the art and include for example, viral titer assays.

Generally, the dosage ranges for the administration of the anti-RSV antibodies or antigen-binding fragments thereof provided herein are those large enough to produce the desired effect in which the symptom(s) of the pathogen-mediated disease (e.g. viral disease) are ameliorated or the likelihood of virus infection is decreased. In some examples, the anti-RSV antibodies or antigen-binding fragments thereof provided herein are administered in an amount effective for inducing an immune response in the subject. The dosage is not so large as to cause adverse side effects, such as hyperviscosity syndromes, pulmonary edema or congestive heart failure. Generally, the dosage will vary with the age, condition, sex and the extent of the disease in the patient and can be determined by one of skill in the art. The dosage can be adjusted by the individual physician in the event of the appearance of any adverse side effect. Exemplary dosages for the prevention or treatment of a RSV infection and/or amelioration of one or more symptoms of a RSV infection include, but are not limited to, about or 0.01 mg/kg to about or 300 mg/kg, such as for example, about or 0.01 mg/kg, about or 0.1 mg/kg, about or 0.5 mg/kg, about or 1 mg/kg, about or 5 mg/kg, about or 10 mg/kg, about or 15 mg/kg, about or 20 mg/kg, about or 25 mg/kg, about or 30 mg/kg, about or 35 mg/kg, about or 40 mg/kg, about or 45 mg/kg, about or 50 mg/kg, about or 100 mg/kg, about or 150 mg/kg, about or 200 mg/kg, about or 250 mg/kg, or about or 300 mg/kg.

In some examples, the anti-RSV antibodies or antigen-binding fragments thereof provided herein are administered to a subject at a dosage effective to achieve a desired serum titer. In particular examples, the anti-RSV antibodies or antigen-binding fragments thereof provided herein are administered for the prevention or treatment of a RSV infection and/or amelioration of one or more symptoms of a RSV infection at an amount effective to achieve a serum titer of at least or about 1 μg/ml, at least or about 2 μg/ml, at least or about 3 μg/ml, at least or about 4 μg/ml, at least or about 5 μg/ml, at least or about 6 μg/ml, at least or about 7 μg/ml, at least or about 8 μg/ml, at least or about 9 μg/ml, at least or about 10 μg/ml, at least or about 15 μg/ml, at least or about 20 μg/ml, at least or about 25 μg/ml, at least or about 30 μg/ml, at least or about 40 μg/ml, at least or about 50 μg/ml, at least or about 60 μg/ml, at least or about 70 μg/ml, at least or about 80 μg/ml, at least or about 90 μg/ml, at least or about 100 μg/ml, at or about 1 day, 2 days, 3 days, 4 days, 5 days, 6 days, 7 days, 8 days, 9 days, 10 days, 15 days, 20 days, 25 days, 30 days, 35 days or 40 days following administration of a first dose of the antibody or antigen-binding fragment thereof and prior to a subsequent dose of the antibody or antigen-binding fragment thereof.

In some examples, the anti-RSV antibodies or antigen-binding fragments thereof provided herein are administered by pulmonary delivery to a subject at a dosage effective to achieve a desired titer in an intubation sample, sputum or lavage from the lungs. In particular examples, the anti-RSV antibodies or antigen-binding fragments thereof provided herein are administered for the prevention or treatment of a RSV infection and/or amelioration of one or more symptoms of a RSV infection at an amount effective to achieve a titer of 10 ng/mg (ng anti-RSV antibody or antigen-binding fragment thereof per mg lung protein) or about 10 ng/mg, 15 ng/mg or about 15 ng/mg, 20 ng/mg or about 20 ng/mg, 25 ng/mg or about 25 ng/mg, 30 ng/mg or about 30 ng/mg, 40 ng/mg or about 40 ng/mg, 50 ng/mg or about 50 ng/mg, 60 ng/mg or about 60 ng/mg, 70 ng/mg or about 70 ng/mg, 80 ng/mg or about 80 ng/mg, 90 ng/mg or about 90 ng/mg, 100 ng/mg or about 100 ng/mg, 110 ng/mg or about 110 ng/mg, 120 ng/mg or about 120 ng/mg, 130 ng/mg or about 130 ng/mg, 140 ng/mg or about 140 ng/mg, or 150 ng/mg or about 150 ng/mg in an intubation sample or lavage from the lungs at or about 10 days, 15 days, 20 days, 25 days, 30 days, 35 days or 40 days following administration of a first dose of the antibody or antigen-binding fragment thereof and prior to a subsequent dose of the antibody or antigen-binding fragment thereof.

For treatment of a viral infection, the dosage of the anti-RSV antibodies or antigen-binding fragments thereof can vary depending on the type and severity of the disease. The anti-RSV antibodies or antigen-binding fragments thereof can be administered single dose, in multiple separate administrations, or by continuous infusion. For repeated administrations over several days or longer, depending on the condition, the treatment can be repeated until a desired suppression of disease symptoms occurs or the desired improvement in the patient's condition is achieved. Repeated administrations can include increased or decreased amounts of the anti-RSV antibody or antigen-binding fragment thereof depending on the progress of the treatment. Other dosage regimens also are contemplated.

In some examples, the anti-RSV antibodies or antigen-binding fragments thereof provided herein are administered one time, two times, three times, four times, five times, six time, seven times, eight times, nine times, ten times or more per day or over several days. In particular examples, the anti-RSV antibodies or antigen-binding fragments thereof provided herein are administered one time, two times, three times, four times, five times, six time, seven times, eight times, nine times, ten times or more for the prevention or treatment of a RSV infection and/or amelioration of one or more symptoms of a RSV infection at an amount effective to achieve a serum titer of at least or about 1 μg/ml, at least or about 2 μg/ml, at least or about 3 μg/ml, at least or about 4 μg/ml, at least or about 5 μg/ml, at least or about 6 μg/ml, at least or about 7 μg/ml, at least or about 8 μg/ml, at least or about 9 μg/ml, at least or about 10 μg/ml, at least or about 15 μg/ml, at least or about 20 μg/ml, at least or about 25 μg/ml, at least or about 30 μg/ml, at least or about 40 μg/ml, at least or about 50 μg/ml, at least or about 60 μg/ml, at least or about 70 μg/ml, at least or about 80 μg/ml, at least or about 90 μg/ml, at least or about 100 μg/ml, at or about 1 day, 2 days, 3 days, 4 days, 5 days, 6 days, 7 days, 8 days, 9 days, 10 days, 15 days, 20 days, 25 days, 30 days, 35 days or 40 days following administration of a first dose, second dose, third dose, fourth dose, fifth dose, sixth dose, seventh dose, eighth dose, ninth dose, tenth dose of the antibody or antigen-binding fragment thereof and prior to a subsequent dose of the antibody or antigen-binding fragment thereof. In a particular example, the anti-RSV antibodies or antigen-binding fragments thereof provided herein are administered four times for the prevention or treatment of a RSV infection and/or amelioration of one or more symptoms of a RSV infection at an amount effective to achieve a serum titer of at least or about 72 μg/ml at or about 1 day, 2 days, 3 days, 4 days, 5 days, 6 days, 7 days, 8 days, 9 days, 10 days, 15 days, 20 days, 25 days, 30 days, 35 days or 40 days following administration of the fourth dose of the antibody or antigen-binding fragment thereof and prior to a subsequent dose of the antibody or antigen-binding fragment thereof.

In some examples, the anti-RSV antibodies or antigen-binding fragments thereof are administered in a sequence of two or more administrations, where the administrations are separated by a selected time period. In some examples, the selected time period is at least or about 1 day, 2 days, 3 days, 4 days, 5 days, 6 days, 1 week, 2 weeks, 3 weeks, 1 month, 2 months, or 3 months.

In some examples, a prophylactically effective amount of an anti-RSV antibody or antigen-binding fragment thereof provided herein is administered one or more times just prior to RSV season. In some examples, a prophylactically effective amount of an anti-RSV antibody or antigen-binding fragment thereof provided herein is administered one or more times just prior to RSV season and/or one or more times during RSV season.

Therapeutic efficacy of a particular dosage or dosage regimen also can be assessed, for example, by measurement of viral titer in the subject prior to and following administration of one or more doses of the anti-RSV antibody or antigen-binding fragment thereof. Dosage amounts and/or frequency of administration can be modified depending on the desired rate of clearance of the virus in the subject.

As will be understood by one of skill in the art, the optimal treatment regimen will vary and it is within the scope of the treatment methods to evaluate the status of the disease under treatment and the general health of the patient prior to, and following one or more cycles of therapy in order to determine the optimal therapeutic dosage and frequency of administration. It is to be further understood that for any particular subject, specific dosage regimens can be adjusted over time according to the individual need and the professional judgment of the person administering or supervising the administration of the pharmaceutical formulations, and that the dosages set forth herein are exemplary only and are not intended to limit the scope thereof. The amount of an anti-RSV antibody or antigen-binding fragment thereof to be administered for the treatment of a disease or condition, for example a viral infection (e.g. a RSV virus infection), can be determined by standard clinical techniques (e.g. viral titer or antigen detection assays). In addition, in vitro assays and animal models can be employed to help identify optimal dosage ranges. Such assays can provide dosages ranges that can be extrapolated to administration to subjects, such as humans. Methods of identifying optimal dosage ranges based on animal models are well known by those of skill in the art.

3. Routes of Administration

The anti-RSV antibodies or antigen-binding fragments thereof provided herein can be administered to a subject by any method known in the art for the administration of polypeptides, including for example systemic or local administration. The anti-RSV antibodies or antigen-binding fragments thereof can be administered by routes, such as parenteral (e.g., intradermal, intramuscular, intraperitoneal, intravenous, subcutaneous, or intracavity), topical, epidural, or mucosal (e.g., intranasal or oral). The anti-RSV antibodies or antigen-binding fragments thereof can be administered externally to a subject, at the site of the disease for exertion of local or transdermal action. Compositions containing anti-RSV antibodies or antigen-binding fragments thereof can be administered by any convenient route, for example by infusion or bolus injection, by absorption through epithelial or mucocutaneous linings (e.g., oral mucosa, rectal and intestinal mucosa). Compositions containing anti-RSV antibodies or antigen-binding fragments thereof can be administered together with other biologically active agents. The mode of administration can include topical or other administration of a composition on, in or around areas of the body that can come on contact with fluid, cells, or tissues that are infected, contaminated or have associated therewith a virus, such as a RSV virus. The anti-RSV antibodies or antigen-binding fragments thereof provided herein can be administered by topical or aerosol routes for delivery directly to target organs, such as the lung (e.g., by pulmonary aerosol). In some examples, the provided anti-RSV antibodies or antigen-binding fragments thereof can be administered as a controlled release formulation as such as by a pump (see, e.g., Langer (1990) *Science* 249:1527-1533; Sefton (1987) *CRC Crit. Ref. Biomed. Eng.* 14:20; Buchwald et al. (1980) *Surgery* 88:507; and Saudek et al. (1989) *N. Engl. J. Med.* 321:574) or via the use of various polymers known in the art and described elsewhere herein. In some examples, a controlled or sustained release system can be placed in proximity of the therapeutic target, for examples, the lungs, thus requiring only a fraction of the systemic dose (see, e.g., Goodson, in Medical Applications of Controlled Release, supra, vol. 2, pp. 115-138(1984)).

In particular examples, the provided anti-RSV antibodies or antigen-binding fragments thereof are administered by pulmonary delivery (see, e.g., U.S. Pat. Nos. 6,019,968, 5,985, 320, 5,985,309, 5,934,272, 5,874,064, 5,855,913, 5,290,540, and 4,880,078; and PCT Publication Nos. WO 92/19244, WO 97/32572, WO 97/44013, WO 98/31346, and WO 99/66903). Exemplary methods of pulmonary delivery are known in the art and include, but are not limited to, aerosol methods, such as inhalers (e.g., pressurized metered dose inhalers (MDI), dry powder inhalers (DPI), nebulizers (e.g., jet or ultrasonic nebulizers) and other single breath liquid systems), intratracheal instillation and insufflation. In some examples, pulmonary delivery can be enhanced by co-administration of or administration of a co-formulation containing the anti-RSV antibodies or antigen-binding fragments thereof provided herein and a permeation enhancer, such as, for example, surfactants, fatty acids, saccharides, chelating agents and enzyme inhibitors, such as protease inhibitors.

Appropriate methods for delivery, such as pulmonary delivery, can be selected by one of skill in the art based on the properties of the dosage amount of the anti-RSV antibody or antigen-binding fragment thereof or the pharmaceutical composition containing the antibody or antigen-binding fragment thereof. Such properties include, but are not limited to, solubility, hygroscopicity, crystallization properties, melting point, density, viscosity, flow, stability and degradation profile.

In some examples, the anti-RSV antibodies or antigen-binding fragments thereof provided herein increase the efficacy mucosal immunization against a virus. Thus, in particular examples the anti-RSV antibodies or antigen-binding fragments thereof are administered to a mucosal surface. For example, the anti-RSV antibodies or antigen-binding fragments thereof can be delivered via routes such as oral (e.g., buccal, sublingual), ocular (e.g., corneal, conjunctival, intravitreally, intra-aqueous injection), intranasal, genital (e.g., vaginal), rectal, pulmonary, stomachic, or intestinal. The anti-RSV antibodies or antigen-binding fragments thereof provided herein can be administered systemically, such as parenterally, for example, by injection or by gradual infusion over time or enterally (i.e., digestive tract). The anti-RSV antibodies or antigen-binding fragments thereof provided herein also can be administered topically, such as for example, by topical installation or application (e.g., intratracheal instillation and insufflation using a bronchoscope or other artificial airway) of liquid solutions, gels, ointments, powders or by inhalation (e.g., nasal sprays, inhalers (e.g., pressurized metered dose inhalers (MDI), dry powder inhalers (DPI), nebulizers (e.g., jet or ultrasonic nebulizers) and other single breath liquid systems)). Administration can be effected prior to exposure to the virus or subsequent to exposure to the virus.

4. Combination Therapies

The anti-RSV antibodies or antigen-binding fragments thereof provided herein can be administered alone or in combination with one or more therapeutic agents or therapies for the prophylaxis and/or treatment of a disease or condition. For example, the provided anti-RSV antibodies or antigen-binding fragments thereof can be administered in combination with one or more antiviral agents for the prophylaxis and/or treatment of a viral infection, such as a respiratory viral infection. In some examples, the respiratory viral infection is a RSV infection. The antiviral agents can include agents to decrease and/or eliminate the pathogenic infection or agents to alleviate one or more symptoms of a pathogenic infection. In some examples, a plurality of antibodies or antigen-binding fragments thereof (e.g., one or more antiviral antibodies) also can be administered in combination, where at least one of the antibodies is an anti-RSV antibody or antigen-binding fragment thereof provided herein. In some examples, a plurality of antibodies can be administered in combination for the prophylaxis and/or treatment of a RSV infection or multiple viral infections, where at least one of the antibodies is an anti-RSV antibody or antigen-binding fragment thereof provided herein. In some examples, the anti-RSV antibodies provided can be administered in combination with one or more antiviral antibodies, which bind to and neutralize a virus, such as RSV. In some examples, the anti-RSV antibodies or antigen-binding fragments thereof provided can be administered in combination with one or more antibodies, which can inhibit or alleviate one or more symptoms of a viral infection, such as a RSV infection. In some examples, two or more of the anti-RSV antibodies or antigen-binding fragments thereof provided herein are administered in combination.

The one or more additional agents can be administered simultaneously, sequentially or intermittently with the anti-RSV antibody or antigen-binding fragment thereof. The agents can be co-administered with the anti-RSV antibody or antigen-binding fragment thereof, for example, as part of the same pharmaceutical composition or same method of delivery. In some examples, the agents can be co-administered with the anti-RSV antibody or antigen-binding fragment thereof at the same time as the anti-RSV antibody or antigen-binding fragment thereof, but by a different means of delivery. The agents also can be administered at a different time than administration of the anti-RSV antibody or antigen-binding fragment thereof, but close enough in time to the administration of the anti-RSV antibody or antigen-binding fragment thereof to have a combined prophylactic or therapeutic effect. In some examples, the one or more additional agents are administered subsequent to or prior to the administration of the anti-RSV antibody or antigen-binding fragment thereof separated by a selected time period. In some examples, the time period is 1 day, 2 days, 3 days, 4 days, 5 days, 6 days, 1 week, 2 weeks, 3 weeks, 1 month, 2 months, or 3 months. In some examples, the one ore more additional agents are administered multiple times and/or the anti-RSV antibody or antigen-binding fragment thereof provided herein is administered multiple times.

In some examples, administration of the combination inhibits the incidence of RSV infection by at least or about 99%, at least or about 95%, at least or about 90%, at least or about 85%, at least or about 80%, at least or about 75%, at least or about 70%, at least or about 65%, at least or about 60%, at least or about 55%, at least or about 50%, at least or about 45%, at least or about 40%, at least or about 35%, at least or about 30%, at least or about 25%, at least or about 20%, at least or about 15%, or at least or about 10% relative to the incidence of RSV infection in the absence of the combination. In some examples, administration of the combination decreases the severity of one or more symptoms of RSV infection by at least or about 99%, at least or about 95%, at least or about 90%, at least or about 85%, at least or about 80%, at least or about 75%, at least or about 70%, at least or about 65%, at least or about 60%, at least or about 55%, at least or about 50%, at least or about 45%, at least or about 40%, at least or about 35%, at least or about 30%, at least or about 25%, at least or about 20%, at least or about 15%, or at least or about 10% relative to the severity of the one or more symptoms of RSV infection in the absence of the combination.

In some examples, the combination inhibits the binding of RSV to its host cell receptor by at least or about 99%, at least or about 95%, at least or about 90%, at least or about 85%, at least or about 80%, at least or about 75%, at least or about 70%, at least or about 65%, at least or about 60%, at least or about 55%, at least or about 50%, at least or about 45%, at least or about 40%, at least or about 35%, at least or about 30%, at least or about 25%, at least or about 20%, at least or about 15%, or at least or about 10% relative to the binding of RSV to its host cell receptor in the absence of the combination. In some examples, the combination inhibits RSV replication by at least or about 99%, at least or about 95%, at least or about 90%, at least or about 85%, at least or about 80%, at least or about 75%, at least or about 70%, at least or about 65%, at least or about 60%, at least or about 55%, at least or about 50%, at least or about 45%, at least or about 40%, at least or about 35%, at least or about 30%, at least or about 25%, at least or about 20%, at least or about 15%, or at least or about 10% relative to RSV replication in the absence of the combination.

Any therapy which is known to be useful, or which is or has been used for the prevention, management, treatment, or amelioration of a RSV infection or one or more symptoms thereof can be used in combination with anti-RSV antibody or antigen-binding fragment thereof provided herein (see, e.g., Gilman et al., Goodman and Gilman's: The Pharmacological Basis of Therapeutics, 10th ed., McGraw-Hill, New York, 2001; The Merck Manual of Diagnosis and Therapy, Berkow, M. D. et al. (eds.), 17th Ed., Merck Sharp & Dohme Research Laboratories, Rahway, N.J., 1999; Cecil Textbook of Medicine, 20th Ed., Bennett and Plum (eds.), W.B. Saunders, Philadelphia, 1996, for information regarding therapies (e.g., prophylactic or therapeutic agents) which have been or are used for preventing, treating, managing, or ameliorating a RSV infection or one or more symptoms thereof). Examples of such agents include, but are not limited to, immunomodulatory agents, anti-inflammatory agents (e.g., adrenocorticoids, corticosteroids (e.g., beclomethasone, budesonide, flunisolide, fluticasone, triamcinolone, methylprednisolone, prednisolone, prednisone, hydrocortisone), glucocorticoids, steroids, non-steroidal anti-inflammatory drugs (e.g. aspirin, ibuprofen, diclofenac, and COX-2 inhibitors)), pain relievers, leukotriene antagonists (e.g., montelukast, methyl xanthines, zafirlukast, and zileuton), bronchodilators, such as β2-agonists (e.g., bambuterol, bitolterol, clenbuterol, fenoterol, formoterol, indacaterol, isoetharine, metaproterenol, pirbuterol, procaterol, reproterol, rimiterol, salbutamol (Albuterol, Ventolin), levosalbutamol, salmeterol, tulobuterol and terbutaline) and anticholinergic agents (e.g., ipratropium bromide and oxitropium bromide), sulphasalazine, penicillamine, dapsone, antihistamines, anti-malarial agents (e.g., hydroxychloroquine), and antiviral agents. The anti-RSV antibodies or antigen-binding fragments thereof provided herein also can be administered in combination with one or more therapies for the treatment of a RSV infection, including but not limited to, administration of intravenous infusion of immunoglobulin, administration of supplemental oxygen and fluids or assisted breathing. The anti-RSV antibodies or antigen-binding fragments thereof provided herein also can be administered in combination with one or more agents that regulate lung maturation and surfactant protein expression, such as, but not limited to, glucocorticoids, PPARγ ligands, and vascular endothelial cell growth factor (VEGF).

Exemplary antiviral agents that can be selected for combination therapy with an anti-RSV antibody or antigen-binding fragment thereof provided herein include, but are not limited to, antiviral compounds, antiviral proteins, antiviral peptides, antiviral protein conjugates and antiviral peptide conjugates, including, but not limited to, nucleoside analogs, nucleotide analogs, immunomodulators (e.g. interferons) and immunostimulants. Combination therapy using antibodies and/or anti-RSV antibodies and antigen-binding fragments provided herewith are contemplated as is combination with the antibodies and/or anti-RSV antibodies and antigen-binding fragments provided herein with other anti-RSV antibodies and anti-RSV antibodies and antigen-binding fragments.

Exemplary antiviral agents for the treatment of viral infections that can be administered in combination with the anti-RSV antibodies or antigen-binding fragments thereof provided herein include, but are not limited to, acyclovir, famciclovir, ganciclovir, penciclovir, valacyclovir, valganciclovir, idoxuridine, trifluridine, brivudine, cidofovir, docosanol, fomivirsen, foscarnet, tromantadine, imiquimod, podophyllotoxin, entecavir, lamivudine, telbivudine, clevudine, adefovir, tenofovir, boceprevir, telaprevir, pleconaril, arbidol, amantadine, rimantadine, oseltamivir, zanamivir, peramivir, inosine, interferon (e.g., Interferon alfa-2b, Peginterferon alfa-2a), ribavirin/taribavirin, abacavir, emtricitabine, lamivudine, didanosine, zidovudine, apricitabine, stampidine, elvucitabine, racivir, amdoxovir, stavudine, zalcitabine, tenofovir, efavirenz, nevirapine, etravirine, rilpivirine, loviride, delavirdine, atazanavir, fosamprenavir, lopinavir, darunavir, nelfinavir, ritonavir, saquinavir, tipranavir, amprenavir, indinavir, enfuvirtide, maraviroc, vicriviroc, PRO 140, ibalizumab, raltegravir, elvitegravir, bevirimat, vivecon, including tautomeric forms, analogs, isomers, polymorphs, solvates, derivatives, or salts thereof.

Exemplary antiviral agents for the prophylaxis and/or treatment of RSV infections that can be administered in combination with the anti-RSV antibodies or antigen-binding fragments thereof provided herein include, but are not limited to, ribavirin, NIH-351 (Gemini Technologies), recombinant RSV vaccine (Aviron), RSVf-2 (Intracel), F-50042 (Pierre Fabre), T-786 (Trimeris), VP-36676 (ViroPharma), RFI-641 (American Home Products), VP-14637 (ViroPharma), PFP-1 and PFP-2 (American Home Products), RSV vaccine (Avant Immunotherapeutics), F-50077 (Pierre Fabre), and other anti-RSV antibodies or antigen-binding fragments thereof.

The anti-RSV antibodies or antigen-binding fragments thereof provided herein also can be administered in combination with one or more agents capable of stimulating cellular immunity, such as cellular mucosal immunity. Any agent capable of stimulatory cellular immunity can be used. Exemplary immunostimulatory agents include, cytokines, such as, but not limited to, interferons (e.g., IFN-$\alpha$, $\beta$, $\gamma$, $\omega$), lymphokines and hematopoietic growth factors, such as, for example, GM-CSF (granulocyte macrophage colony stimulating factor), Interleukin-2 (IL-2), Interleukin-3 (IL-3), Interleukin-4 (IL-4), Interleukin-7 (IL-7), Interleukin-10 (IL-10), Interleukin-12 (IL-12), Interleukin-14 (IL-14), and Tumor Necrosis Factor (TNF).

For combination therapies with anti-pathogenic agents, dosages for the administration of such compounds are known in the art or can be determined by one skilled in the art according to known clinical factors (e.g., subject's species, size, body surface area, age, sex, immunocompetence, and general health, duration and route of administration, the kind and stage of the disease, and whether other treatments, such as other anti-pathogenic agents, are being administered concurrently).

a. Antiviral Antibodies for Combination Therapy

The anti-RSV antibodies or antigen-binding fragments thereof provided herein can be administered in combination with one or more additional antibodies or antigen-binding fragments thereof In some examples, the one or more additional antibodies are antiviral antibodies. In some examples, the one or more additional antibodies bind to a viral antigen. In some examples, the one or more additional antibodies bind to a viral antigen that is a surface protein, such as a viral capsid protein or a viral envelop protein. In some examples, the one or more additional antibodies bind to a viral antigen that is expressed on the surface of an infected cell. In some examples, the one or more additional antibodies bind to a viral antigen that is expressed intracellularly (i.e., within an infected cell). In some examples, the one or more additional antibodies binds to a virus that causes respiratory disease, such as, but not limited to, RSV, parainfluenza virus (PIV) or human metapneumovirus (hMPV). Compositions containing the mixtures of antibodies also are provided herein.

Antibodies for use in combination with an anti-RSV antibody or antigen-binding fragment thereof provided herein include, but are not limited to, monoclonal antibodies, multispecific antibodies, synthetic antibodies, human antibodies, humanized antibodies, chimeric antibodies, intrabodies, single-chain Fvs (scFv), single chain antibodies, Fab fragments, F(ab') fragments, disulfide-linked Fvs (sdFv), and anti-idiotypic (anti-Id) antibodies (including, e.g., anti-Id antibodies to antibodies provided herein), and epitope-binding fragments of any of the above. The antibodies for use in combination with an anti-RSV antibody or antigen-binding fragment thereof provided herein can be of any type (e.g., IgG, IgE, IgM, IgD, IgA and IgY), class (e.g., $IgG_1$, $IgG_2$, $IgG_3$, $IgG_4$, $IgA_1$ and $IgA_2$) or subclass of immunoglobulin molecule.

Antibodies for use in combination with an anti-RSV antibody or antigen-binding fragment thereof provided herein can be from any animal origin, including birds and mammals (e.g., human, murine, donkey, sheep, rabbit, goat, guinea pig, camel, horse, or chicken). Typically, the antibodies for use in combination with an anti-RSV antibody or antigen-binding fragment thereof provided herein are human or humanized antibodies. The antibodies for use in combination with an anti-RSV antibody or antigen-binding fragment thereof provided herein can be monospecific, bispecific, trispecific or of greater multispecificity.

The antibodies for use in combination with an anti-RSV antibody or antigen-binding fragment thereof provided herein can include derivative antibodies that are modified, for example, by the attachment of any type of molecule to the antibody or antigen-binding fragment thereof such as by covalent attachment. Exemplary antibody or antigen-binding fragment thereof derivatives include antibodies that have been modified, for example, by glycosylation, acetylation, pegylation, phosphorylation, amidation, derivatization by known protecting/blocking groups, proteolytic cleavage, linkage to a cellular ligand or other protein, or contain heterologous Fc domain with higher affinities for the FcRN receptor (see, e.g. U.S. Pat. No. 7,083,784). Any of numerous chemical modifications can be carried out by known techniques, including, but not limited to, specific chemical cleavage, acetylation, formylation, or synthesis in the presence of tunicamycin. Additionally, the derivative can contain one or more non-classical amino acids.

The one or more additional antibodies for use in combination with an anti-RSV antibody or antigen-binding fragment thereof provided herein can be administered simultaneously, sequentially or intermittently with the anti-RSV antibody or antigen-binding fragment thereof. The one or more additional antibodies can be co-administered with the anti-RSV antibody or antigen-binding fragment thereof, for example, as part of the same pharmaceutical composition or same method of delivery. In some examples, the one or more additional antibodies can be co-administered with the anti-RSV antibody or antigen-binding fragment thereof at the same time as the anti-RSV antibody or antigen-binding fragment thereof, but by a different means of delivery. The one or more additional antibodies also can be administered at a different time than administration of the anti-RSV antibody or antigen-binding fragment thereof provided herein, but close enough in time to the administration of the anti-RSV antibody or antigen-binding fragment thereof to have a combined prophylactic or therapeutic effect. In some examples, the one or more additional antibodies are administered subsequent to or prior to the administration of the anti-RSV antibody or antigen-binding fragment thereof separated by a selected time period. In some examples, the time period is 1 day, 2 days, 3 days, 4 days, 5 days, 6 days, 1 week, 2 weeks, 3 weeks, 1 month, 2 months, or 3 months. In some examples, the one ore more additional antibodies are administered multiple times and/or the anti-RSV antibody or antigen-binding fragment thereof provided herein is administered multiple times.

i. Anti-RSV Antibodies

In some examples, the one or more additional antiviral antibodies are anti-RSV antibodies or antigen-binding fragments thereof. In some examples, an anti-RSV antibody or antigen-binding fragment thereof provided herein is administered in combination with the one or more additional anti-RSV antibodies or antigen-binding fragments thereof for the prophylaxis and/or treatment of a RSV infection. Exemplary anti-RSV antibodies or antigen-binding fragments thereof for combination therapy with an anti-RSV antibody or antigen-binding fragment thereof provided herein include anti-RSV antibodies or antigen-binding fragments thereof that immunospecifically bind to and neutralize RSV. In some examples, the one or more additional anti-RSV antibodies or antigen-binding fragments thereof includes an antibody or antigen-binding fragment thereof that immunospecifically binds to RSV A subtype and/or RSV B subtype.

In some examples, the one or more additional antiviral antibodies for combination therapy with an anti-RSV antibody or antigen-binding fragment provided herein includes an anti-RSV antibody that binds to a RSV attachment protein (e.g. having an amino acid sequence set forth in SEQ ID NO: 1520), a RSV RNA polymerase beta subunit large structural protein) (L protein) (e.g. having an amino acid sequence set forth in SEQ ID NO: 1521), a RSV nucleocapsid protein (e.g. having an amino acid sequence set forth in SEQ ID NO: 1522), a RSV nucleoprotein (N) (e.g. having an amino acid sequence set forth in SEQ ID NO: 1523), a RSV phosphoprotein P (e.g. having an amino acid sequence set forth in SEQ ID NO: 1524), a RSV matrix protein (e.g. having an amino acid sequence set forth in SEQ ID NO: 1525), a RSV small hydrophobic (SH) protein (e.g. having an amino acid sequence set forth in SEQ ID NO: 1526), a RSV RNA-dependent polymerase, a RSV F protein (e.g. having an amino acid sequence set forth in SEQ ID NO: 1527), a RSV G protein (e.g. having an amino acid sequence set forth in SEQ ID NO: 1528), or an allelic variant of any of the above. In particular examples, the one or more additional antiviral antibodies includes an anti-RSV antibody that binds to a RSV F protein. In particular examples, the one or more additional antiviral antibodies that bind to a RSV F protein bind to the A, B, C, I, II, IV, V, or VI antigenic sites of a RSV F glycoprotein (see, e.g., Lopez et al. (1998) *J. Virol.* 72:6922-6928).

In some examples, the one or more additional antiviral antibodies for combination therapy with an anti-RSV antibody or antigen-binding fragment thereof provided herein includes, but is not limited to, palivizumab (SYNAGIS®), motavizumab (NUMAX®), AFFF, P12f2, P12f4, P11d4, A1e9, A12a6, A13c4, A17d4, A4B4, A8c7, 1X-493L1, FR H3-3F4, M3H9, Y10H6, DG, AFFF(1), 6H8, L1-7E5, L2-15B10, A13a11, A1h5, A4B4(1), A4B4L1FR-S28R, A4B4-F52S, (see U.S. Pat. Nos. 5,824,307 and 6,818,216), rsv6, rsv11, rsv13, rsv19, rsv21, rsv22, rsv23 (see U.S. Pat. No. 6,685,942), RF-1, RF-2 (see U.S. Pat. No. 5,811,524), or antigen-binding fragments thereof. In some examples, the one or more additional antiviral antibodies for combination therapy includes an antibody or antigen-binding fragment thereof containing a $V_H$ chain and/or $V_L$ chain having the amino acid sequence of a $V_H$ chain and/or $V_L$ chain of palivizumab (SYNAGIS®), motavizumab (NUMAX®), AFFF, P12f2, P12f4, P11d4, A1e9, A12a6, A13c4, A17d4, A4B4, A8c7, 1X-493L1, FR H3-3F4, M3H9, Y10H6, DG, AFFF(1), 6H8, L1-7E5, L2-15B10, A13a11, A1h5, A4B4(1), A4B4L1FR-S28R, A4B4-F52rsv6, rsv11, rsv13, rsv19, rsv21, rsv22, rsv23, RF-1, or RF-2. In some examples, the one or more additional antiviral antibodies for combination therapy includes an antibody or antigen-binding fragment thereof containing one or more CDRs of palivizumab (Synagis®), motavizumab (Numax®), AFFF, P12f2, P12f4, P11d4, A1e9, A12a6, A13c4, A17d4, A4B4, A8c7, 1X-493L1, FR H3-3F4, M3H9, Y10H6, DG, AFFF(1), 6H8, L1-7E5, L2-15B10, A13a11, A1h5, A4B4(1), A4B4L1FR-S28R, A4B4-F52S, rsv6, rsv11, rsv13, rsv19, rsv21, rsv22, rsv23, RF-1, or RF-2. In some examples, the one or more additional antiviral antibodies for combination therapy includes an antibody or antigen-binding fragment thereof containing one or more CDRs of from an anti-RSV mouse monoclonal antibody such as, but not limited to, MAbs 1153, 1142, 1200, 1214, 1237, 1129, 1121, 1107, 1112, 1269, 1269, 1243 (Beeler et al. (1989) *J. Virology* 63(7):2841-2950), MAb151 (Mufson et al. (1987) *J. Microbiol.* 25:1635-1539), MAbs 43-1 and 13-1 (Fernie et al. (1982) *Proc. Soc. Exp. Biol. Med.* 171:266-271), MAbs 1436C, 1302A, 1308F, and 1331H (Anderson et al. (1984) *J. Clin. Microbiol.* 19:934-936). Additional exemplary antibodies or antigen-binding fragments thereof that can be used for combination therapy with an anti-RSV antibody or antigen-binding fragment provided herein include, but are not limited to, anti-RSV antibodies or antigen-binding fragments thereof described in, for example, U.S. Pat. Nos. 6,413,771, 5,840,298, 5,811,524, 6,656,467, 6,537,809, 7,364,742, 7,070,786, 5,955,364, 7,488,477, 6,818,216, 5,824,307, 7,364,737, 6,685,942, and 5,762,905 and U.S. Patent Pub. Nos. 2007-0082002, 2005-0175986, 2004-0234528, 2006-0198840, 2009-0110684, 2006-0159695, 2006-0013824, 2005-0288491, 2005-0019758, 2008-0226630, 2009-0137003, and 2009-0092609.

In some examples, the one or more additional antiviral antibodies for combination therapy with an anti-RSV antibody or antigen-binding fragment thereof provided herein includes an antibody or antigen-binding fragment thereof containing a $V_H$ chain having an amino acid sequence set forth in any of SEQ ID NOS: 103, 113, 122, 131, 137, 144, 149, 155, 161, 167, 172, 176, 179, 182, 186, 190, 194, 198, 201, 205, 210, 215, 222, 356, 363, 369, 376, 382, 387, 1607, and 1611. In some examples, the one or more additional antiviral antibodies for combination therapy with an anti-RSV antibody or antigen-binding fragment thereof provided herein includes an antibody or antigen-binding fragment thereof containing a $V_H$ domain having an amino acid sequence set forth in any of SEQ ID NOS: 104, 114, 123, 132, 138, 145, 150, 156, 162, 168, 173, 187, 206, 357, 362, 364, 370, 377, 383, and 388. In some examples, the one or more additional antiviral antibodies for combination therapy with an anti-RSV antibody or antigen-binding fragment thereof provided herein includes an antibody or antigen-binding fragment thereof containing a $V_H$ CDR1 having an amino acid sequence set forth in any of SEQ ID NOS: 105, 115, 124, 1608, and 1612. In particular examples, the one or more additional antiviral antibodies for combination therapy with an anti-RSV antibody or antigen-binding fragment thereof provided herein includes an antibody or antigen-binding fragment thereof containing a $V_H$ CDR1 having the amino acid sequence TSGMSVG (SEQ ID NO:105), TAGMSVG (SEQ ID NO:115), AYAMS (SEQ ID NO:1608), or GYTMH (SEQ ID NO:1612). In some examples, the one or more additional antiviral antibodies for combination therapy with an anti-RSV antibody or antigen-binding fragment thereof provided herein includes an antibody or antigen-binding fragment thereof containing a $V_H$ CDR2 having an amino acid sequence set forth in any of SEQ ID NOS: 106, 125, 133, 157, 226-235, 365, 389, 397-408, 1609, and 1613. In a particular example, the one or more additional antiviral antibodies for combination therapy with an anti-RSV antibody or antigen-binding fragment thereof provided herein includes an antibody or antigen-binding fragment thereof containing a $V_H$ CDR2 having the amino acid sequence DIWWDDKK-DYNPSLKS (SEQ ID NO:106) or DIWWD-DKKHYNPSLKD (SEQ ID NO:125), GISGSGDSTDY-ADSVKG (SEQ ID NO:1609), or SITGGSNFINYSDSVKG (SEQ ID NO:1613). In some examples, the one or more additional antiviral antibodies for combination therapy with an anti-RSV antibody or antigen-binding fragment thereof provided herein includes an antibody or antigen-binding fragment thereof containing a $V_H$ CDR3 having an amino acid sequence set forth in any of SEQ ID NOS: 107, 116, 126, 139, 188, 236-238, 371, 1610, and 1614. In a particular example, the one or more additional antiviral antibodies for combination therapy with an anti-RSV antibody or antigen-binding fragment thereof provided herein includes an antibody or antigen-binding fragment thereof containing a $V_H$ CDR3 having the amino acid sequence SMITNWYFDV (SEQ ID NO:107), DMIFNFYFDV (SEQ ID NO:126), HLPDY-WNLDYTRFFYYMDV (SEQ ID NO:1610), or APIAPPY-FDH (SEQ ID NO:1614).

In some examples, the one or more additional antiviral antibodies for combination therapy with an anti-RSV antibody or antigen binding fragment thereof provided herein includes an antibody or antigen-binding fragment thereof containing a $V_L$ chain having an amino acid sequence set forth in any of SEQ ID NOS: 108, 117, 127, 134, 140, 146, 152, 158, 164, 169, 174, 177, 180, 183, 189, 191, 195, 199, 202, 207, 211, 216, 220, 223, 358, 366, 372, 378, 384, 390, 393, 1615, 1619, and 1623. In some examples, the one or more additional antiviral antibodies for combination therapy with an anti-RSV antibody or antigen-binding fragment thereof provided herein includes an antibody or antigen-binding fragment thereof containing a $V_L$ domain having an amino acid sequence set forth in any of SEQ ID NOS: 109, 118, 128, 135; 141, 147, 153, 159, 165, 170, 175, 178, 181, 184, 192, 196, 200, 203, 208, 212, 217, 221, 224, 359, 367, 373, 379, 385, 391 and 394. In some examples, the one or more additional antiviral antibodies for combination therapy with an anti-RSV antibody or antigen-binding fragment thereof provided herein includes an antibody or antigen-binding fragment thereof containing a $V_L$ CDR1 having an amino acid sequence set forth in any of SEQ ID NOS: 110, 119, 129, 142, 154, 166, 239-255, 257-297, 299-314, 374, 380, 395, 409-544, 1616, 1620, and 1624. In a particular example, the one or more additional antiviral antibodies for combination therapy with an anti-RSV antibody or antigen-binding fragment thereof provided herein includes an antibody or antigen-binding fragment thereof containing a $V_L$ CDR1 having the amino acid sequence KCQLSVGYMH (SEQ ID NO:110), SASS-RVGYMH (SEQ ID NO:154), RATQSISSNYLA (SEQ ID NO:1616), KASQNINDNLA (SEQ ID NO:1620), or RATQSVSNFLN (SEQ ID NO:1624). In some examples, the one or more additional antiviral antibodies for combination therapy with an anti-RSV antibody or antigen-binding fragment thereof provided herein includes an antibody or antigen-binding fragment thereof containing a $V_L$ CDR2 having an amino acid sequence set forth in any of SEQ ID NOS: 111, 120, 136, 143, 160, 171, 185, 218, 225, 315-355, 360, 368, 375, 381, 386, 392, 396, 545-1509. 1617, 1621, and 1625. In a particular example, the one or more additional antiviral antibodies for combination therapy with an anti-RSV antibody or antigen-binding fragment thereof provided herein includes an antibody or antigen-binding fragment thereof containing a $V_L$ CDR2 having the amino acid sequence DTSKLAS (SEQ ID NO:111), DTLLLDS (SEQ ID NO:218), GASNRAT (SEQ ID NO:1617), GASSRAT (SEQ ID NO:1621), or DASTSQS (SEQ ID NO:1625). In some examples, the one or more additional antiviral antibodies for combination therapy with an anti-RSV antibody or antigen-binding fragment thereof provided herein includes an antibody or antigen-binding fragment thereof containing a $V_L$ CDR3 having an amino acid sequence set forth in any of SEQ ID NOS: 112, 121, 193, 1510-1511, 1618, 1622, and 1626. In a particular example, the one or more additional antiviral antibodies for combination therapy with an anti-RSV antibody or antigen-binding fragment thereof provided herein includes an antibody or antigen-binding fragment thereof containing a $V_L$ CDR3 having the amino acid sequence FQGSGYPFT (SEQ ID NO:112), QQYDISPYT (SEQ ID NO:1618), QQYGGSPYT (SEQ ID NO:1622), or QAS-INTPL (SEQ ID NO:1626).

In some examples, the anti-RSV antibody or antigen-binding fragment thereof provided herein can be administered in combination with hyperimmune serum or immune globulin enriched for anti-RSV antibodies, such as, for example, RSV hyperimmune globulin (RSV IVIG; RespiGam®; MedImmune Inc, Gaithersburg, Md.; see, e.g., Groothius et al. (1993) *New Eng. J. Med* 329:1524-1530).

ii. Antibodies Against Other Respiratory Viruses

In some examples, the one or more additional antiviral antibodies for combination therapy with an anti-RSV antibody or antigen-binding fragment thereof provided herein includes an antibody or antigen-binding fragment thereof to an respiratory virus other than RSV, for example, selected from among an anti-human metapneumovirus (hMPV) antibody, an anti-parainfluenzavirus (PIV) antibody, an anti-avian pneumovirus (APV) antibody or other antiviral antibody known in the art.

In some examples, where the one or more additional antiviral antibodies for combination therapy with an anti-RSV antibody or antigen-binding fragment thereof provided herein is an anti-PIV antibody, an antibody that immunospecifically binds to a PIV antigen, such as, for example, a PIV nucleocapsid phosphoprotein, a PIV fusion (F) protein, a PIV phosphoprotein, a PIV large (L) protein, a PIV matrix (M) protein, a PIV hemagglutinin-neuraminidase (HN) glycoprotein, a PIV RNA-dependent RNA polymerase, a PIV Y1 protein, a PIV D protein, a PIV C protein, or an allelic variant of any of the above. In particular examples, the PIV antigen is PIV F protein. In some examples, the anti-PIV antibody is an antibody that immunospecifically binds to an antigen of human PIV type 1, human PIV type 2, human PIV type 3, and/or human PIV type 4.

In some examples, where the one or more additional antiviral antibodies for combination therapy with an anti-RSV antibody or antigen-binding fragment thereof provided herein is an anti-hMPV antibody, an antibody that immunospecifically binds to a hMPV antigen, such as, for example, a hMPV nucleoprotein, a hMPV phosphoprotein, a hMPV matrix protein, a hMPV small hydrophobic protein, a hMPV RNA-dependent RNA polymerase, a hMPV F protein, a hMPV G protein, or an allelic variant of any of the above. In particular examples, the hMPV antigen is PIV F protein. In some examples, the anti-hMPV antibody is an antibody that immunospecifically binds to an antigen of hMPV type A and/or hMPV type B. In some examples, the anti-hMPV antibody is an antibody that immunospecifically binds to an antigen of hMPV sub-type A1 and/or A2 and/or hMPV sub-type B1 and/or B2.

Antibodies administered in combination with an anti-RSV antibody or antigen-binding fragment thereof provided herein can be any type of antibody or antigen-binding fragment known in the art. For example, an antibody or antigen-binding fragment thereof administered in combination with an anti-RSV antibody or antigen-binding fragment thereof provided herein can include, but is not limited to, a monoclonal antibody, a human antibody, a non-human antibody, a recombinantly produced antibody, a chimeric antibody, a humanized antibody, a multispecific antibody (e.g., a bispecific antibody), an intrabody, and an antibody fragment, such as, but not limited to, a Fab fragment, a Fab' fragment, a $F(ab')_2$ fragment, a Fv fragment, a disulfide-linked Fv (dsFv), a Fd fragment, a Fd' fragment, a single-chain Fv (scFv), a single-chain Fab (scFab), a diabody, an anti-idiotypic (anti-Id) antibody, or antigen-binding fragments of any of the above. Antibodies administered in combination with an anti-RSV antibody provided herein can include members of any immunoglobulin type (e.g., IgG, IgM, IgD, IgE, IgA and IgY), any class (e.g. IgG1, IgG2, IgG3, IgG4, IgA1 and IgA2) or subclass (e.g., IgG2a and IgG2b).

In some examples, administration of the combination of antiviral antibodies or antigen-binding fragments inhibits the incidence of RSV infection by at least or about 99%, at least or about 95%, at least or about 90%, at least or about 85%, at least or about 80%, at least or about 75%, at least or about 70%, at least or about 65%, at least or about 60%, at least or about 55%, at least or about 50%, at least or about 45%, at least or about 40%, at least or about 35%, at least or about 30%, at least or about 25%, at least or about 20%, at least or about 15%, or at least or about 10% relative to the incidence of RSV infection in the absence of the anti-RSV antibody or antigen-binding fragment. In some examples, administration of the combination of antiviral antibodies or antigen-binding fragments decreases the severity of one or more symptoms of RSV infection by at least or about 99%, at least or about 95%, at least or about 90%, at least or about 85%, at least or about 80%, at least or about 75%, at least or about 70%, at least or about 65%, at least or about 60%, at least or about 55%, at least or about 50%, at least or about 45%, at least or about 40%, at least or about 35%, at least or about 30%, at least or about 25%, at least or about 20%, at least or about 15%, or at least or about 10% relative to the severity of the one or more symptoms of RSV infection in the absence of the combination of antiviral antibodies or antigen-binding fragments.

In some examples, the combination of antiviral antibodies or antigen-binding fragments inhibits the binding of RSV to its host cell receptor by at least or about 99%, at least or about 95%, at least or about 90%, at least or about 85%, at least or about 80%, at least or about 75%, at least or about 70%, at least or about 65%, at least or about 60%, at least or about 55%, at least or about 50%, at least or about 45%, at least or about 40%, at least or about 35%, at least or about 30%, at least or about 25%, at least or about 20%, at least or about 15%, or at least or about 10% relative to the binding of RSV to its host cell receptor in the absence of the combination of antiviral antibodies or antigen-binding fragments. In some examples, the combination of antiviral antibodies or antigen-binding fragments inhibits RSV replication by at least or about 99%, at least or about 95%, at least or about 90%, at least or about 85%, at least or about 80%, at least or about 75%, at least or about 70%, at least or about 65%, at least or about 60%, at least or about 55%, at least or about 50%, at least or about 45%, at least or about 40%, at least or about 35%, at least or about 30%, at least or about 25%, at least or about 20%, at least or about 15%, or at least or about 10% relative to RSV replication in the absence of the combination of antiviral antibodies or antigen-binding fragments.

5. Gene Therapy

In some examples, nucleic acids comprising sequences encoding the anti-RSV antibodies, antigen-binding fragments and/or derivatives thereof, are administered to treat, prevent or ameliorate one or more symptoms associated with RSV infection, by way of gene therapy. Gene therapy refers to therapy performed by the administration to a subject of an expressed or expressible nucleic acid. In this example, the nucleic acids produce their encoded antibody or antigen-binding fragment thereof that mediates a prophylactic or therapeutic effect.

Any of the methods for gene therapy available in the art can be employed for administration of nucleic acid encoding the anti-RSV antibodies, antigen-binding fragments and/or derivatives thereof. Exemplary methods are described below.

For general reviews of the methods of gene therapy, see, for example, Goldspiel et al. (1993) *Clinical Pharmacy* 12:488-505; Wu and Wu (1991) *Biotherapy* 3:87-95; Tolstoshev (1993) *Ann. Rev. Pharmacol. Toxicol.* 32:573-596; Mulligan (1993) *Science* 260:926-932; Morgan and Anderson (1993) *Ann. Rev. Biochem.* 62:191-217; and *TIBTECH* 11(5):155-215. Methods commonly known in the art of recombinant DNA technology which can be used are described in Ausubel et al. (eds.), Current Protocols in Molecular Biology, John Wiley & Sons, NY (1993); and Kriegler, Gene Transfer and Expression, A Laboratory Manual, Stockton Press, NY (1990).

In some examples, a composition provided herein contains nucleic acids encoding an anti-RSV antibody, an antigen-binding fragment and/or derivative thereof, where the nucleic acids are part of an expression vector that expresses the anti-RSV antibody, antigen-binding fragment and/or derivative thereof in a suitable host. In particular, such nucleic acids have promoters, such as heterologous promoters, operably linked to the antibody coding region, said promoter being inducible or constitutive, and, optionally, tissue-specific. In another particular embodiment, nucleic acid molecules are used in which the antibody coding sequences and any other desired sequences are flanked by regions that promote homologous recombination at a desired site in the genome, thus providing for intrachromosomal expression of the antibody encoding nucleic acids (Koller and Smithies (1989) *Proc. Natl. Acad. Sci. USA* 86:8932-8935; Zijlstra et al. (1989) *Nature* 342:435-438). In some examples, the expressed antibody molecule is a single chain antibody. In some examples, the nucleic acid sequences include sequences encoding the heavy and light chains, or fragments thereof, of the antibody. In a particular example, the nucleic acid sequences include sequences encoding an anti-RSV Fab fragment. In a particular example, the nucleic acid sequences include sequences encoding a full-length anti-RSV antibody. In some examples, the encoded anti-RSV antibody is a chimeric antibody.

Delivery of the nucleic acids into a subject can be either direct, in which case the subject is directly exposed to the nucleic acid or nucleic acid-carrying vectors, or indirect, in which case, cells are first transformed with the nucleic acids in vitro, then transplanted into the subject. These two approaches are known, respectively, as in vivo or ex vivo gene therapy.

In some examples, the nucleic acid sequences are directly administered in vivo, where it is expressed to produce the encoded product. This can be accomplished by any of numerous methods known in the art, for example, by constructing them as part of an appropriate nucleic acid expression vector and administering it so that they become intracellular, for example, by infection using defective or attenuated retroviral or other viral vectors (see U.S. Pat. No. 4,980,286), or by direct injection of naked DNA, or by use of microparticle bombardment (e.g., a gene gun; Biolistic, Dupont), or coating with lipids or cell-surface receptors or transfecting agents, encapsulation in liposomes, microparticles, or microcapsules, or by administering them in linkage to a peptide which is known to enter the nucleus, by administering it in linkage to a ligand subject to receptor-mediated endocytosis (see, e.g., Wu and Wu (1987) *J. Biol. Chem.* 262:4429-4432) which can be used, for example, to target cell types specifically expressing the receptors. In some examples, nucleic acid-ligand complexes can be formed in which the ligand contains a fusogenic viral peptide to disrupt endosomes, allowing the nucleic acid to avoid lysosomal degradation. In some examples, the nucleic acid can be targeted in vivo for cell specific uptake and expression, by targeting a specific receptor (see, e.g., PCT Publications WO 92/06180; WO 92/22635; WO92/203 16; WO93/14188, and WO 93/20221). Alternatively, the nucleic acid can be introduced intracellularly and incorporated within host cell DNA for expression, by homologous recombination (Koller and Smithies (1989) *Proc. Natl. Acad. Sci. USA* 86:8932-8935; and Zijlstra et al. (1989) *Nature* 342:435-438).

In a some examples, viral vectors that contains nucleic acid sequences encoding an anti-RSV antibody, antigen-binding fragments and/or derivatives thereof are used. For example, a retroviral vector can be used (see, e.g., Miller et al. (1993) *Meth. Enzymol.* 217:581-599). Retroviral vectors contain the components necessary for the correct packaging of the viral genome and integration into the host cell DNA. The nucleic acid sequences encoding the antibody or antigen-binding fragment thereof to be used in gene therapy are cloned into one or more vectors, which facilitates delivery of the gene into a subject. More detail about retroviral vectors can be found, for example, in Boesen et al. (1994) *Biotherapy* 6:291-302. Other references illustrating the use of retroviral vectors in gene therapy include, for example, Clowes et al. (1994) *J. Clin. Invest.* 93:644-651; Klein et al. (1994) *Blood* 83:1467-1473; Salmons and Gunzberg (1993) *Human Gene Therapy* 4:129-141; and Grossman and Wilson (1993) *Curr. Opin. in Genetics and Devel.* 3:110-114.

Adenoviruses also are viral vectors that can be used in gene therapy. Adenoviruses are especially attractive vehicles for delivering genes to respiratory epithelia. Adenoviruses naturally infect respiratory epithelia where they cause a mild disease. Other targets for adenovirus-based delivery systems include the liver, central nervous system, endothelial cells, and muscle. Adenoviruses have the advantage of being capable of infecting non-dividing cells. Kozarsky and Wilson (1993) *Current Opinion in Genetics and Development* 3:499-503 present a review of adenovirus-based gene therapy. Bout et al. (1994) *Human Gene Therapy* 5:3-10 demonstrated the use of adenovirus vectors to transfer genes to the respiratory epithelia of rhesus monkeys. Other instances of the use of adenoviruses in gene therapy can be found, for examples, in Rosenfeld et al. (1991) *Science* 252:431-434; Rosenfeld et al. (1992) *Cell* 68:143-155; Mastrangeli et al. (1993) *J. Clin. Invest.* 91:225-234; PCT Publication WO94/12649; and Wang et al. (1995) *Gene Therapy* 2:775-783. In a particular example, adenovirus vectors are used to deliver nucleic acid encoding the an anti-RSV antibodies, antigen-binding fragments and/or derivatives thereof provided herein.

Adeno-associated virus (AAV) also can be used in gene therapy (Walsh et al. (1993) *Proc. Soc. Exp. Biol. Med.* 204:289-300; and U.S. Pat. No. 5,436,146). In a particular example, adeno-associated virus (AAV) vectors are used to deliver nucleic acid encoding the anti-RSV antibodies, antigen-binding fragments and/or derivatives thereof provided herein.

Another approach to gene therapy involves transferring a gene to cells in tissue culture by such methods as electroporation, lipofection, calcium phosphate mediated transfection, or viral infection. Generally, the method of transfer includes the transfer of a selectable marker to the cells. The cells are then placed under selection to isolate those cells that have taken up and are expressing the transferred gene. The cells expressing the gene are then delivered to a subject.

In some examples, the nucleic acid encoding an anti-RSV antibody, antigen-binding fragments and/or derivatives thereof provided herein is introduced into a cell prior to administration in vivo of the resulting recombinant cell. Such introduction can be carried out by any method known in the art, including, but not limited to, transfection, electroporation, microinjection, infection with a viral or bacteriophage vector containing the nucleic acid sequences, cell fusion, chromosome-mediated gene transfer, microcell-mediated gene transfer, and spheroplast fusion. Numerous techniques are known in the art for the introduction of foreign genes into cells (see, e.g., Loeffler and Behr (1993) *Meth. Enzymol.* 217:599-618; Cohen et al. (1993) *Meth. Enzymol.* 217:618-644; Cline (1985) *Pharmacol. Ther.* 29:69-92) and can be used for the administration of nucleic acid encoding an anti-RSV antibody, antigen-binding fragment and/or derivative thereof provided herein, provided that the necessary developmental and physiological functions of the recipient cells are not disrupted. The technique provides for the stable transfer of the nucleic acid to the cell, so that the nucleic acid is expressible by the cell and typically heritable and expressible by its cell progeny.

The resulting recombinant cells can be delivered to a subject by various methods known in the art. Recombinant blood cells (e.g., hematopdietic stem or progenitor cells) can be administered intravenously. The amount of cells for administration depends on various factors, including, for example, the desired prophylactic and/or therapeutic effect and patient state, and can be determined by one skilled in the art.

Cells into which a nucleic acid can be introduced for purposes of gene therapy encompass any desired, available cell type, and include, but are not limited to, epithelial cells, endothelial cells, keratinocytes, fibroblasts, muscle cells, hepatocytes; blood cells such as T lymphocytes, B lymphocytes, monocytes, macrophages, neutrophils, eosinophils, megakaryocytes, granulocytes; various stem or progenitor cells, in particular hematopoietic stem or progenitor cells, for example, as obtained from bone marrow, umbilical cord blood, peripheral blood, and fetal liver. In particular examples, the cell used for gene therapy is autologous to the subject.

In some examples in which recombinant cells are used in gene therapy, nucleic acid sequences encoding an anti-RSV antibody, antigen-binding fragments and/or derivatives thereof provided herein are introduced into the cells such that they are expressible by the cells or their progeny, and the recombinant cells are then administered in vivo for therapeutic effect. In a particular example, stem or progenitor cells are used. Any stem and/or progenitor cells which can be isolated and maintained in vitro can be used (see e.g., PCT Publication WO 94/08598; Stemple and Anderson (1992) *Cell* 7 1:973-985; Rheinwald (1980) *Meth. Cell Bio.* 21A:229; and Pittelkow and Scott (1986) *Mayo Clinic Proc.* 61:771).

In a particular example, the nucleic acid to be introduced for purposes of gene therapy contains an inducible promoter operably linked to the coding region, such that expression of the nucleic acid is controllable by controlling the presence or absence of the appropriate inducer of transcription.

J. PHARMACEUTICAL COMPOSITIONS, COMBINATIONS AND ARTICLES OF MANUFACTURE/KITS

1. Pharmaceutical Compositions

Provided herein are pharmaceutical compositions containing an anti-RSV antibody or antigen-binding fragment thereof provided herein. The pharmaceutical composition can be used for therapeutic, prophylactic, and/or diagnostic applications. The anti-RSV antibodies or antigen-binding fragments thereof provided herein can be formulated with a pharmaceutical acceptable carrier or diluent. Generally, such pharmaceutical compositions utilize components which will not significantly impair the biological properties of the antibody or antigen-binding fragment thereof, such as the binding of to its specific epitope (e.g. binding to an epitope on a RSV F protein). Each component is pharmaceutically and physiologically acceptable in the sense of being compatible with the other ingredients and not injurious to the patient. The formulations can conveniently be presented in unit dosage form and can be prepared by methods well known in the art of pharmacy, including but not limited to, tablets, pills, powders, liquid solutions or suspensions (e.g., including injectable, ingestible and topical formulations (e.g., eye drops, gels or ointments), aerosols (e.g., nasal sprays), liposomes, suppositories, injectable and infusible solution and sustained release forms. See, e.g., Gilman, et al. (eds. 1990) Goodman and Gilman's: The Pharmacological Bases of Therapeutics, 8th Ed., Pergamon Press; and Remington's Pharmaceutical Sciences, 17th ed. (1990), Mack Publishing Co., Easton, Pa.; Avis, et al. (eds. 1993) Pharmaceutical Dosage Forms: Parenteral Medications, Dekker, N.Y.; Lieberman, et al. (eds. 1990) Pharmaceutical Dosage Forms: Tablets, Dekker, N.Y.; and Lieberman, et al. (eds. 1990) Pharmaceutical Dosage Forms: Disperse Systems, Dekker, N.Y. When administered systematically, the therapeutic composition is sterile, pyrogen-free, generally free of particulate matter, and in a parenterally acceptable solution having due regard for pH, isotonicity, and stability. These conditions are known to those skilled in the art. Methods for preparing parenterally administrable compositions are well known or will be apparent to those skilled in the art and are described in more detail in, e.g., "Remington: The Science and Practice of Pharmacy (Formerly Remington's Pharmaceutical Sciences)", 19th ed., Mack Publishing Company, Easton, Pa. (1995).

Pharmaceutical compositions provided herein can be in various forms, e.g., in solid, semi-solid, liquid, powder, aqueous, or lyophilized form. Examples of suitable pharmaceutical carriers are known in the art and include but are not limited to water, buffering agents, saline solutions, phosphate buffered saline solutions, various types of wetting agents, sterile solutions, alcohols, gum arabic, vegetable oils, benzyl alcohols, gelatin, glycerin, carbohydrates such as lactose, sucrose, amylose or starch, magnesium stearate, talc, silicic acid, viscous paraffin, perfume oil, fatty acid monoglycerides and diglycerides, pentaerythritol fatty acid esters, hydroxy methylcellulose, powders, among others. Pharmaceutical compositions provided herein can contain other additives including, for example, antioxidants, preservatives, antimicrobial agents, analgesic agents, binders, disintegrants, coloring, diluents, excipients, extenders, glidants, solubilizers, stabilizers, tonicity agents, vehicles, viscosity agents, flavoring agents, emulsions, such as oil/water emulsions, emulsifying and suspending agents, such as acacia, agar, alginic acid, sodium alginate, bentonite, carbomer, carrageenan, carboxymethylcellulose, cellulose, cholesterol, gelatin, hydroxyethyl cellulose, hydroxypropyl cellulose, hydroxypropyl methylcellulose, methylcellulose, octoxynol 9, oleyl alcohol, povidone, propylene glycol monostearate, sodium lauryl sulfate, sorbitan esters, stearyl alcohol, tragacanth, xanthan gum, and derivatives thereof, solvents, and miscellaneous ingredients such as crystalline cellulose, microcrystalline cellulose, citric acid, dextrin, dextrose, liquid glucose, lactic acid, lactose, magnesium chloride, potassium metaphosphate, starch, among others (see, generally, Alfonso R. Gennaro (2000) Remington: The Science and Practice of Pharmacy, 20th Edition. Baltimore, Md.: Lippincott Williams & Wilkins). Such carriers and/or additives can be formulated by conventional methods and can be administered to the subject at a suitable dose. Stabilizing agents such as lipids, nuclease inhibitors, polymers, and chelating agents can preserve the compositions from degradation within the body.

Pharmaceutical compositions suitable for use include compositions wherein one or more anti-RSV antibodies are contained in an amount effective to achieve their intended purpose. Determination of a therapeutically effective amount is well within the capability of those skilled in the art. Therapeutically effective dosages can be determined by using in vitro and in vivo methods as described herein. Accordingly, an anti-RSV antibody or antigen-binding fragment thereof provided herein, when in a pharmaceutical preparation, can be present in unit dose forms for administration.

An anti-RSV antibody or antigen-binding fragment thereof provided herein can be lyophilized for storage and reconstituted in a suitable carrier prior to use. This technique has been shown to be effective with conventional immunoglobulins and protein preparations and art-known lyophilization and reconstitution techniques can be employed.

An anti-RSV antibody or antigen-binding fragment thereof provided herein can be provided as a controlled release or sustained release composition. Polymeric materials are known in the art for the formulation of pills and capsules which can achieve controlled or sustained release of the antibodies or antigen-binding fragments thereof provided herein (see, e.g., Medical Applications of Controlled Release, Langer and Wise (eds.), CRC Pres., Boca Raton, Fla. (1974); Controlled Drug Bioavailability, Drug Product Design and Performance, Smolen and Ball (eds.), Wiley, New York (1984); Ranger and Peppas (1983) *J., Macromol. Sci. Rev. Macromol. Chem.* 23:61; see also Levy et al. (1985) *Science* 228:190; During et al. (1989) *Ann. Neurol.* 25:351; Howard et al. (1989) *J. Neurosurg.* 7 1:105; U.S. Pat. Nos. 5,679,377, 5,916,597, 5,912,015, 5,989,463, 5,128,326; PCT Publication Nos. WO 99/15154 and WO 99/20253). Examples of polymers used in sustained release formulations include, but are not limited to, poly(2-hydroxy ethyl methacrylate), poly (methyl methacrylate), poly(acrylic acid), poly(ethylene-co-vinyl acetate), poly(methacrylic acid), polyglycolides (PLG), polyanhydrides, poly(N-vinyl pyrrolidone), poly(vinyl alcohol), polyacrylamide, poly(ethylene glycol), polylactides (PLA), poly(lactide-co-glycolides) (PLGA), and polyorthoesters. Generally, the polymer used in a sustained release formulation is inert, free of leachable impurities, stable on storage, sterile, and biodegradable. Any technique known in the art for the production of sustained release formulation can be used to produce a sustained release formulation containing one or more anti-RSV antibodies or antigen-binding fragments provided herein.

In some examples, the pharmaceutical composition contains an anti-RSV antibody or antigen-binding fragment thereof provided herein and one or more additional antibodies. In some examples, the one or more additional antibodies includes, but is not limited to, palivizumab (SYNAGIS®), and derivatives thereof, such as, but not limited to, motavizumab (NUMAX®), AFFF, P12f2, P12f4, P11d4, A1e9, A12a6, A13c4, A17d4, A4B4, A8c7, 1X-493L1, FR H3-3F4, M3H9, Y10H6, DG, AFFF(1), 6H8, L1-7E5, L2-15B10, A13a11, A1h5, A4B4(1), A4B4L1FR-S28R, and A4B4-F52S (see U.S. Pat. Nos. 5,824,307 and 6,818,216), rsv6, rsv11, rsv13, rsv19, rsv21, rsv22, rsv23 (see, e.g. U.S. Pat. Nos. 5,824,307, 6,685,942 and 6,818,216), a human anti-RSV antibody, such as, but not limited to, rsv6, rsv11, rsv13, rsv19 (i.e. Fab 19), rsv21, rsv22, rsv23, RF-1, RF-2 (see, e.g. U.S. Pat. Nos. 6,685,942 and 5,811,524), a humanized antibody derived from an anti-RSV mouse monoclonal antibody such as, but not limited to, MAbs 1153, 1142, 1200, 1214, 1237, 1129, 1121, 1107, 1112, 1269, 1269, 1243 (Beeler et al. (1989) *J. Virology* 63(7):2841-2950), MAb151 (Mufson et al. (1987) *J. Clin. Microbiol.* 25:1635-1539), MAbs 43-1 and 13-1 (Fernie et al. (1982) *Proc. Soc. Exp. Biol. Med.* 171:266-271), MAbs 1436C, 1302A, 1308F, and 1331H (Anderson et al. (1984) *J. Clin. Microbiol.* 19:934-936), or antigen-binding fragments thereof. Additional exemplary antibodies or antigen-binding fragments thereof that can be used in a pharmaceutical composition containing an anti-RSV antibody or antigen-binding fragment thereof provided herein include, but are not limited to, anti-RSV antibodies or antigen-binding fragments thereof described in, for example, U.S. Pat. Nos. 6,413,771, 5,840,298, 5,811,524, 6,656,467, 6,537,809, 7,364,742, 7,070,786, 5,955,364, 7,488,477, 6,818,216, 5,824,307, 7,364,737, 6,685,942, and 5,762,905 and U.S. Patent Pub. Nos. 2007-0082002, 2005-0175986, 2004-0234528, 2006-0198840, 2009-0110684, 2006-0159695, 2006-0013824, 2005-0288491, 2005-0019758, 2008-0226630, 2009-0137003, and 2009-0092609.

2. Articles of Manufacture/Kits

Pharmaceutical compositions of anti-RSV antibodies or nucleic acids encoding anti-RSV antibodies, or a derivative or a biologically active portion thereof can be packaged as articles of manufacture containing packaging material, a pharmaceutical composition which is effective for prophylaxis (i.e. vaccination, passive immunization) and/or treating the RSV-mediated disease or disorder, and a label that indicates that the antibody or nucleic acid molecule is to be used for vaccination and/or treating the disease or disorder. The pharmaceutical compositions can be packaged in unit dosage forms contain an amount of the pharmaceutical composition for a single dose or multiple doses. The packaged compositions can contain a lyophilized powder of the pharmaceutical compositions containing the anti-RSV antibodies or antigen-binding fragments thereof provided, which can be reconstituted (e.g. with water or saline) prior to administration.

The articles of manufacture provided herein contain packaging materials. Packaging materials for use in packaging pharmaceutical products are well known to those of skill in the art. Examples of pharmaceutical packaging materials include, but are not limited to, blister packs, bottles, tubes, inhalers, inhalers (e.g., pressurized metered dose inhalers (MDI), dry powder inhalers (DPI), nebulizers (e.g., jet or ultrasonic nebulizers) and other single breath liquid systems), pumps, bags, vials, containers, syringes, bottles, and any packaging material suitable for a selected formulation and intended mode of administration and treatment. The pharmaceutical composition also can be incorporated in, applied to or coated on a barrier or other protective device that is used for contraception from infection.

The anti-RSV antibodies or antigen-binding fragments thereof, nucleic acid molecules encoding the antibodies thereof, pharmaceutical compositions or combinations provided herein also can be provided as kits. Kits can optionally include one or more components such as instructions for use, devices and additional reagents (e.g., sterilized water or saline solutions for dilution of the compositions and/or reconstitution of lyophilized protein), and components, such as tubes, containers and syringes for practice of the methods. Exemplary kits can include the anti-RSV antibodies or antigen-binding fragments thereof provided herein, and can optionally include instructions for use, a device for administering the anti-RSV antibodies or antigen-binding fragments thereof to a subject, a device for detecting the anti-RSV antibodies or antigen-binding fragments thereof in a subject, a device for detecting the anti-RSV antibodies or antigen-binding fragments thereof in samples obtained from a subject, and a device for administering an additional therapeutic agent to a subject.

The kit can, optionally, include instructions. Instructions typically include a tangible expression describing the anti-RSV antibodies or antigen-binding fragments thereof and, optionally, other components included in the kit, and methods for administration, including methods for determining the proper state of the subject, the proper dosage amount, dosing regimens, and the proper administration method for administering the anti-RSV antibodies or antigen-binding fragments thereof Instructions also can include guidance for monitoring the subject over the duration of the treatment time Kits also can include a pharmaceutical composition described herein and an item for diagnosis. For example, such kits can include an item for measuring the concentration, amount or activity of the selected anti-RSV antibody or antigen-binding fragment thereof in a subject.

In some examples, the anti-RSV antibody or antigen-binding fragment thereof is provided in a diagnostic kit for the detection of RSV in an isolated biological sample (e.g., a fluid sample, such as blood, sputum, lavage, lung intubation sample, saliva, urine or lymph obtained from a subject). In some examples, the diagnostic kit contains a panel of one or more anti-RSV antibodies or antigen-binding fragments thereof and/or one or more control antibodies (i.e. non-RSV binding antibodies), where one or more antibodies in the panel is an anti-RSV antibody or antigen-binding fragment provided herein.

Kits provided herein also can include a device for administering the anti-RSV antibodies or antigen-binding fragments thereof to a subject. Any of a variety of devices known in the art for administering medications to a subject can be included in the kits provided herein. Exemplary devices include, but are not limited to, an inhaler (e.g., pressurized metered dose inhaler (MDI), dry powder inhaler (DPI), nebulizer (e.g., jet or ultrasonic nebulizers) and other single breath liquid system), a hypodermic needle, an intravenous needle, a catheter, and a liquid dispenser such as an eyedropper. Typically the device for administering the anti-RSV antibodies or antigen-binding fragments thereof of the kit will be compatible with the desired method of administration of the anti-RSV antibodies or antigen-binding fragments thereof. For example, an anti-RSV antibody or antigen-binding fragment thereof to be delivered by pulmonary administration can be included in a kit with or contained in an inhaler or a nebulizer.

3. Combinations

Provided are combinations of the anti-RSV antibodies or antigen-binding fragments thereof provided herein and a second agent, such as a second anti-RSV antibody or antigen-binding fragment thereof or other therapeutic or diagnostic agent. A combination can include any anti-RSV antibody or antigen-binding fragment thereof or reagent for effecting therapy thereof in accord with the methods provided herein. For example, a combination can include any anti-RSV antibody or antigen-binding fragment thereof and an antiviral agent. Combinations also can include an anti-RSV antibody or antigen-binding fragment thereof provided herein with one or more additional therapeutic antibodies. Combinations of the anti-RSV antibodies or antigen-binding fragments thereof provided also can contain pharmaceutical compositions containing the anti-RSV antibodies or antigen-binding fragments thereof or host cells containing nucleic acids encoding the anti-RSV antibodies or antigen-binding fragments thereof as described herein. The combinations provided herein can be formulated as a single composition or in separate compositions.

K. EXAMPLES

The following examples are included for illustrative purposes only and are not intended to limit the scope of the invention.

Example 1

Expression of RSV F Protein

In this example, the RSV fusion protein (F protein) from Respiratory Syncytial Virus strain A2 was expressed and purified by capture on ELISA plates using anti-RSV monoclonal antibody clone 2F7, which recognizes both the F0 and F1 subunits of the fusion glycoprotein. In the first example, recombinant RSV F protein containing only the extracellular domain (SEQ ID NO:25) was cloned and expressed in 293F cells. In the second example, native RSV F protein was expressed by infection of HEp-2 cells with RSV A2 strain (SEQ ID NO:1629).

A. Recombinant RSV F Protein

In this example, the gene encoding the RSV F protein from the A2 RSV strain was cloned and expressed. The RSV A2 F gene (SEQ ID NO:21), containing only the extracellular domain (the full length RSV A2 F protein is set forth in SEQ ID NO:1630) was synthesized according to standard DNA synthesis protocols by GeneArt (Burlingame, Calif.). The RSV A2 F gene was engineered to contain a Kozak sequence (nucleotides 7-16 of SEQ ID NO:21), a c-myc sequence (nucleotides 1600-1629 of SEQ ID NO:21), and a 6X-His tag (nucleotides 1645-1662 of SEQ ID NO:21). Additionally, NheI (SEQ ID NO:22) and HindIII (SEQ ID NO:23) restriction sites were engineered at the 5' and 3' ends, respectively, to allow cloning into an expression vector. The DNA was digested using standard molecular biology techniques and ligated into the similarly digested mammalian expression vector pcDNA™ 3.1/myc-His(−) C (SEQ ID NO:24, Invitrogen). The vector containing the RSV A2 F gene was transformed into electrocompetent XL1-Blue cells (Strategene). Individual colonies were selected and grown, and the plasmid DNA was purified. The presence of the RSV A2 F gene insert in the isolated vector was verified by DNA sequencing, and one clone containing the insert was used to produce large-scale preparations of DNA (Megaprep kit, Qiagen).

The RSV A2 F protein was expressed in mammalian cells using the FreeStyle™ 293 Expression System (Invitrogen) according to the manufacturer's instructions. Briefly, $3\times10^7$ cells were co-transfected with 30 μg of RSV A2 F/pcDNA3.1/myc-His(−) C plasmid DNA and 5 μg is pAdVAntage (Promega) and incubated at 37° C. for 72 hrs. Cells were pelleted by centrifugation and 3 mL of cold lysis buffer (300 mM NaCl, 50 mM $NaH_2PO_4$, 1% Triton X-100, Complete™ Protease Inhibitor cocktail (Cat. No. sc-29131, Santa Cruz), pH 8) was added to for every $3\times10^7$ RSV F-transfected 293-F cells. The mixture was rocked at 4° C. for 30 min followed by centrifugation at 14,000 rpm for 30 min at 4° C. The cleared supernatant was transferred to a fresh tube and frozen at −80° C. until ready for use. Prior to capture on an ELISA plate, the supernatant was thawed, briefly centrifuged and diluted 1:1 v/v with PBS containing 0.8% nonfat dry milk (final concentration of 0.4% nonfat dry milk).

B. Native RSV F Protein

In this example, native RSV F protein from the RSV A2 strain (amino acids set forth in SEQ ID NO:1629) was purified from RSV infected HEp-2 cells as follows. Briefly, HEp-2 cells are seeded in a ten-layer cell culture stacker (Corning 3270) using complete EMEM (ATCC 30-2003; containing 10% FBS, 1% L-glutamine, and 1% pen-Strep) and incubated at 37° C. and 5% CO2. Once the cells reached 80% confluence, the HEp-2 monolayer was infected with the RSV A2 virus (ATCC VR-1540) at an multiplicity of infection (MOI) of 0.01-0.1. The infected cells were cultured for 3-5 days until apparent cell syncytia was observed. The infected cells were washed once with PBS and the cells were harvested by adding 500 mL PBS with 5 mM EDTA to the culture stacker and incubating at 37° C. for 1 hr. Cells were collected into 50 mL conical tubes (5×107 cells per tube) and pelleted by centrifugation. The cell pellets were washed 2× with PBS and centrifuged at 1200 rpm for 5 minutes. The cell pellets were stored at −20° C. until further processed. Frozen cells were thawed and 3 mL of cold lysis buffer (300 mM NaCl, 50 mM NaH2PO4, 1% Triton X-100, Complete™ Protease Inhibitor cocktail (Cat. No. sc-29131, Santa Cruz), pH 8) was added to each cell pellet. The cells were rocked at 4° C. for 30 min followed by sonication (3 pulses for 10 seconds each at 10% power) and finally centrifuged at 14,000 rpm for 30 min at 4° C. The cleared supernatant was transferred to a fresh tube and frozen at −80° C. until ready for use. Prior to capture on an ELISA plate, the supernatant was thawed, briefly centrifuged and diluted 1:2000.

C. Capture with Anti-RSV mAb

ELISA plates were coated using 50 μL/well of a 1:400 dilution of anti-RSV mAb (Cat. No. NB110-37246, clone 2F7, Novus Biologicals) in PBS. Unbound antibody was removed and the plates were used immediately for ELISA (see Examples 2 and 4). Alternatively, the plates were frozen for up to 2 weeks at −20° C. Immediately before use, the plates were blocked with 4% nonfat dry milk in 1×PBS for 2 hours at 37° C. The plates were washed twice with PBS containing 0.05% Tween-20 (wash buffer) before addition of the lysate. Capture of the RSV F protein (either recombinant or native) was effected by adding 50 μL of either of the above prepared lysates to each well of the anti-RSV mAb ELISA plate and incubating at 37° C. for 2 hours.

Example 2

Isolation of Anti-RSV Fab Antibodies from EBV-transformed B Cells

In this example, anti-RSV antibodies were isolated from stimulated Epstein Barr virus transformed donor memory B cells, which were screened for binding to RSV F protein followed by in vitro antibody generation.

A. Purification of Donor Peripheral Blood Mononuclear Cells

Peripheral blood mononuclear cells (PMBCs) were obtained from a child care worker who may have been exposed to RSV through contact with children. PBMCs were isolated by density centrifugation over Ficoll Hypaque, according to the manufacturer's instructions 1. CD22+ Isolation and Activation of CD22+ B Cells $3.2\times10^6$ CD22+ B cells were isolated from donor PBMCs using CD22 magnetic beads (Miltenyi, cat. #130-046-401) and LS columns (Miltenyi, cat. #130-042-401). Isolated CD22+ B cells were cultured at $1\times10^6$ cells per well in a 48 well plate in RPMI (Hyclone, cat. #SH30096.01) containing 10% heat-inactivated low IgG fetal bovine serum (FBS, Invitrogen, cat. #16250-078), 1% antibiotics (Hyclone, cat. #SV30010), 1% sodium pyruvate (Hyclone, cat. #SH30239.01) and 1% L-glutamine (Hyclone, cat. #SH30034.01). The isolated B cells were activated with a selection of polyclonal B cell stimulating agents to induce proliferation and antibody production.

2. EBV-Mediated Immortalization of IgG+ B Cells $4.5\times10^6$ activated CD22+ B cells were washed and incubated with 40 μL of FITC-conjugated anti-IgM (BD Biosciences, cat. #555782), 40 μL of FITC-conjugated anti-IgD (BD Biosciences, cat. #555778) and 4 μL of FITC-conjugated anti-IgA (Jacksons Immunoresearch, cat. 309-096-043) antibodies for 15 minutes at 4° C. Cells were washed 1× in PBS (containing 0.5% BSA and 2 mM EDTA) and resuspended in 90 uL of the same buffer. IgG+ B cells were enriched by negative selection of IgM, IgD, IgA expressing cells using 10 μL anti-FITC magnetic beads (Miltenyi, cat. #130-048-701) and LS columns (Miltenyi, cat. #130-042-401) according to the manufacturer's instructions.

Bulk immortalization of B cells was performed by incubating $1.87\times10^6$ IgG+, CD22+ enriched B cells with 0.5 ml EBV supernatant (50% v/v in RMPI-1640 with 10% FCS, ATCC Cat. No. VR-1492 from B95-8 cells) for 16 hours. After infection the cells were washed and cultured ($10^6$/mL in each of two wells in RPMI (Hyclone, cat. #SH30096.01) containing 10% heat-inactivated low IgG fetal bovine serum (FBS, Invitrogen, cat. #16250-078), 1% antibiotics (Hyclone, cat. #SV30010), 1% sodium pyruvate (Hyclone, cat. #SH30239.01) and 1% L-glutamine (Hyclone, cat. #SH30034.01), 200 IU/ml rhIL-2 (R&D Systems Cat. #202-IL-50) with $0.5\times10^6$ irradiated feeder cells per well of a 24 well plate for a further 9 days.

3. B Cell Cloning a. Preparation of Irradiated B-Cell Depleted Feeder Cells for Cloning of B Cells Irradiated B-cell depleted feeder cells were used to help maintain growth of the EBV-transformed B cells. PBMCs from a mixture of 3 healthy donors were obtained by Ficoll separation, irradiated with 3250 rads (at the UCSD Moore's Cancer Center), and depleted of B cells using anti-CD19 magnetic beads (Miltenyi Biotec, Cat. No. 130-050-301) and LD columns (Miltenyi Biotec, cat. #130-091-509). Briefly, frozen and irradiated PMBCs, obtained from Ficoll separation, were thawed, washed twice and counted. The cells were then centrifuged at 300 g for 10 minutes, and the supernatant was aspirated. The cell pellet was resuspended in 80 μl MACS buffer (PBS with 0.5% BSA and 2 mM EDTA) per every $10^7$ cells and 20 μl CD19 MicroBeads (per every $10^7$ cells) was added. Following thorough mixing, the cells were incubated at 4° C. for 15 minutes. The cells were then washed by adding 1-2 mL buffer (per every $10^7$ cells) followed by centrifuging at 300 g for 10 minutes and the supernatant was aspirated. Up to $10^8$ cells were then resuspended in 500 μl buffer. Magnetic separation was effected by placing a LD column (composed of ferromagnetic spheres covered with a plastic coating to allow fast and gentle separation of cells) in the magnetic field of a MACS separator. The LD column was washed with 2 mL buffer and the cell suspension was applied to the top of the column. Non-B cells were collected as they passed through the column after the addition of 2×1 mL buffer.

b. B Cell Cloning

Approximately 20 EBV-transformed B-cells were co-cultured with polyclonal B cell stimulating agents and 50,000 irradiated B-cell depleted feeder cells per well in a 96 well plate and grown for 13 days. A total of 120 96-well plates were generated.

4. Screening of B Cell Supernatant for Binding to RSV F Protein

Supernatants from each well were transferred to a new 96-well plate and the cells were washed 1× in PBS and frozen at −80° C. in 100 μL of RLT buffer (Qiagen, cat. #79216) containing 10 μL/mL 2-mercaptoethanol. The supernatant was used in an ELISA to determine which wells are producing antibodies that are capable of binding to RSV F protein. Briefly, the ELISA was performed as follows: (1) RSV F Protein ELISA plates were prepared as described in Example 1 using 96-well half area plates with the following modifications: anti-RSV mAb (clone 2F7, mouse ascites fluid, Cat. No. ab43812, Abcam) was used as the capture antibody and the RSV F protein was incubated with the capture antibody overnight at 4° C. (2) 10 μL B cell supernatant from each of 2 wells (a total of 20 μL pooled) was added to a 96 half-well ELISA plate and incubated for 2 h at 37° C. Plasma from a pool of Blood Bank donors (collected and frozen after Ficoll Hypaque separation, diluted 1:1000) was used as a positive control. (3) Plates were washed 4× as above and 50 μL of goat anti-human Fc IgG HRP-conjugated antibody (diluted 1:1000 in PBS with 0.05% Tween20) was added to each well and the plate was incubated at 37° C. for 1 hour. (4) Plates were washed 6× as above and developed using 50 μL of 1:1 v/v TMB:peroxide solution (Pierce, Cat No. 34021) substrate and allowed to develop for 7 minutes. The reaction was immediately halted by the addition of 50 μL 2N $H_2SO_4$ and the absorbance at 450 nm was measured using an ELISA plate reader. Positive binding was indicated by an $OD_{450}$ greater than 0.5 (0.5-0.9 is moderate binding, >1 is strong binding) and a response that was 3-fold above background.

To determine which of the two pooled wells contained anti-RSV antibodies, 20 μL of B cell supernatant (diluted 1:2 v/v with PBS/0.05% Tween 20) from each well was retested individually against captured RSV F protein.

A total of 18 plates (or 1080 wells) were screened for binding to RSV F lysate (as purified in Example 1). Six wells were identified as binders to RSV F lysate. Five of the six wells were reconfirmed by an additional ELISA and used to generate anti-RSV antibodies by PCR (described below).

B. Generation of Anti-RSV Antibodies by PCR

Following initial screening of EBV-transformed B cells for production of antibodies that bind to RSV F protein, genes encoding individual antibodies were amplified from B cell RNA by PCR. Five wells identified as hits in Section A were selected for cloning.

1. RNA Extraction

RNA was extracted from the B cells (for each well corresponding to a positive binder to RSV F protein) using an RNeasy Micro Kit (Qiagen, Cat. No. 1402-2408) according to the manufacturer's instructions with the following modifications: 1) B cells were frozen in 100 μL RLT buffer with β-mercaptoethanol (10 μL per mL buffer); 2) the cells were not homogenized; 3) the cells were washed with 70% ethanol (in RNase-free water); and 4) DNase treatment was carried out "in-column" according the manufacturer's supplemental protocol. The RNA was eluted into a final volume of 26 μL.

2. First Strand cDNA Synthesis

Following RNA extraction, cDNA was generated according to the Superscript III (Invitrogen; Cat No. 19090-051) First Strand Synthesis protocol. Briefly, 8 μL RNA (isolated as described above), 1 μL oligo dT primer and 1 μL dNTPs were combined in a sterile 0.2 mL tube and incubated at 65° C. for 5 minutes followed by incubation on ice for 1 minute. Subsequently, 2 μL 0.1 mM DTT, 4 μL 25 mM $MgCl_2$ 2 μL RT buffer, 1 μL RNaseOut, and 1 μL SuperScript III RT were added to the tube, and the reaction mixture was incubated at 50° C. for 50 minutes followed by incubation at 80° C. for 15 minutes. The cDNA was used immediately or frozen at −80° C. for long term storage.

3. Isolation of IgG Heavy Chain and Kappa and Lambda Light Chain Genes by PCR Amplification IgG heavy chains and kappa and lambda light chains were generated by PCR amplification from the B cell first strand cDNA synthesis reaction (see above). The kappa light chain genes were amplified by a single-step PCR, whereas the heavy chain genes and lambda light chain genes were amplified using a two-step, nested PCR approach. The amplified heavy and light chain genes were subsequently linked into a single cassette using "overlap PCR"

Step 1. Amplification of IgG Heavy Chain Genes and Lambda Light Chain Genes

In Step I, 2 μL cDNA generated by First Strand Synthesis (see above) was used as a template to individually amplify IgG heavy chains by PCR. In this step, pools of Step I primers were utilized (see Table 3A below). The reaction conditions were as follows:

PCR Step I: Heavy Chain:

| Reagent | μL |
|---|---|
| $H_2O$ | 16 |
| 10x buffer | 2.5 |
| 10x Enhancer buffer | 2.5 |
| dNTP (10 mM each) | 0.75 |
| cDNA | 2.0 |
| VH pool leader (9 μM each) | 0.5 |
| VH Reverse pool (20 μM) | 0.25 |
| Pfx50 | 0.5 |
| | 25 |

In Step I, Lambda Light Chain, 2.5 μL cDNA generated by First Strand Synthesis (see above) was used as a template to individually amplify IgG heavy chains by PCR. In this step, a pool of Step I primers was utilized for the forward primers and pCALCL(T)-R was used as the reverse primer (see Table 3B below). The reaction conditions were as follows:

PCR Step I: Lambda Light Chain:

| Reagent | μL |
|---|---|
| $H_2O$ | 16 |
| 10x buffer | 2.5 |
| 10x Enhancer buffer | 2.5 |
| dNTP (10 mM each) | 0.75 |
| cDNA | 2.0 |
| Vλ pool (14.2 μM each) | 0.5 |
| pCALCL(T)-R (20 μM) | 0.25 |
| Pfx50 | 0.5 |
| | 25 |

For the PCR reaction, a touchdown approach was implemented in order to add specificity to the reaction amplification. At each touchdown step, the annealing temperature is decreased by 1° C. every cycle. The PCR thermocycler conditions were as follows.

1) 94° C. for 2 minutes
2) 10 cycles of:
   94° C. for 15 seconds; 62° C. for 20 seconds (Touchdown); 68° C. for 1 minute
3) 25 cycles of:
   94° C. for 15 seconds; 52° C. for 20 seconds; 68° C. for 1 minute
4) 68° C. for 3 minutes
5) 4° C. hold The resultant reaction mixtures were used as template DNA for Step II (see below) without any further purification.

TABLE 3A

Step I Primers for Amplifying IgG Heavy Chain Genes

| VH Forward Primer Pool: | | SEQ ID NO |
|---|---|---|
| VH1a | GGATCCTCTTCTTGGTGGCAGCAG | 26 |
| VH1b | GCATCCTTTTCTTGGTGGCAGCAC | 27 |
| VH1c | GGGTCTTCTGCTTGCTGGCTGTAG | 28 |
| VH1d | GGATCCTCTTCTTGGTGGGAGCAG | 29 |
| VH2a | CTGACCATCCCTTCATGGCTCTTG | 30 |
| VH2b | CTGACCACCCCTTCCTGGGTCTTG | 31 |
| VH3a | GCTATTTTARAAGGTGTCCAGTGT | 32 |
| VH3b | GCTCTTTTAAGAGGTGTCCAGTGT | 33 |
| VH3c | GCTATTTAAAAAGGTGTCCAATGT | 34 |
| VH4a | CTGGTGGCAGCTCCCAGATGGGTC | 35 |
| VH5a | CTCCTGGCTGTTCTCCAAGGAGTC | 36 |
| **VH Reverse Primer Pool:** | | **SEQ ID NO** |
| VH-g 1-REV | ACAAGATTTGGGCTCAACTTTCTTGTCC | 37 |
| VH-g 2-REV | TTTGCGCTCAACTGTCTTGTCCACCTTG | 38 |
| VH-g 3-REV | TTTGAGCTCAACTCTCTTGTCCACCTTG | 39 |
| VH-g 4-REV | ATATTTGGACTCAACTCTCTTGTCCACC | 40 |

TABLE 3B

Step I Primers for Amplifying Lambda Light Chain Genes

| VH Forward Primer Pool: | | SEQ ID NO |
|---|---|---|
| 5' L Vλ 1 | GGTCCTGGGCCCAGTCTGTGCTG | 1631 |
| 5' L Vλ 2 | GGTCCTGGGCCCAGTCTGCCCTG | 1632 |
| 5' L Vλ 3 | GCTCTGTGACCTCCTATGAGCTG | 1633 |
| 5' L Vλ 4/5 | GGTCTCTCTCSCAGCYTGTGCTG | 1634 |
| 5' L Vλ 6 | GTTCTIGGGCCAATTTTATGCTG | 1635 |

TABLE 3B-continued

| Step I Primers for Amplifying Lambda Light Chain Genes | | |
|---|---|---|
| 5' L Vλ 7 | GGTCCAATTCYCAGGCTGTGGTG | 1636 |
| 5' L Vλ 8 | GAGTGGATTCTCAGACTGTGGTG | 1637 |
| | Reverse Primer: | SEQ ID NO |
| pCALCL(T)-R | CTCCTTATTAATTAATTATGAGC ATTCTGYAKGGGCMAYTGTC | 80 |

Step II. Amplification of IgG Heavy Chain and Lambda Light Chain Genes

In Step II, the heavy chain and lambda light chain reaction mixtures from Step I were used as templates for second round PCR reactions with pools of forward and reverse primers that amplify from the framework 1 region of each chain to the end of the first constant region ($C_H1$ for heavy chain, CL for light chain).

The heavy chain forward primers (see Table 4) were designed to introduce a SfiI restriction site (SEQ ID NO:41). The reaction conditions were as follows:

PCR II: Heavy Chain

| Reagent | μL |
|---|---|
| $H_2O$ | 12.75 |
| 10x buffer | 2.5 |
| 10X Enhancer | 2.5 |
| dNTP (10 mM each) | 0.75 |
| Step I reaction | 2.5 |
| pCAL24VH-F pool (2 μM) | 2.5 |
| CH1-R Pool-Sfi (20 μM) | 1 |
| Pfx50 | 0.5 |
| | 25 |

The lambda light chain forward primers (see Table 6) were designed to introduce a SfiI restriction site (SEQ ID NO:41). The reaction conditions were as follows:

PCR II: Lambda Light Chain

| Reagent | μL |
|---|---|
| $H_2O$ | 15.5 |
| 10x buffer | 2.5 |
| 10X Enhancer | 2.5 |
| dNTP (10 mM each) | 0.75 |
| Step I Reaction | 2.5 |
| Vλ Primer Pool (2 μM) | 0.5 |
| pCALCL(T)R (20 μM) | 0.25 |
| Pfx50 | 0.50 |
| | 25 |

The PCR thermocycler conditions for Step II reactions were as follows:

1) 94° C. for 2 minutes
2) 30 cycles of:
94° C. for 15 seconds; 52° C. for 20 seconds; 68° C. for 1 minute
3) 68° C. for 3 minutes
4) 4° C. hold For amplification of light chain genes, 2 μL cDNA generated by First Strand Synthesis (see above) was used as a template to individually amplify IgG kappa and lambda light chains by PCR. The light chain kappa forward primers (see Table 5) were used as primer pools and were designed to introduce a SfiI restriction site (SEQ ID NO:41).

The reaction conditions were as follows:

PCR II: Kappa Light Chain

| Reagent | μL |
|---|---|
| $H_2O$ | 16 |
| 10x buffer | 2.5 |
| 10X Enhancer | 2.5 |
| dNTP (10 mM each) | 0.75 |
| First Strand cDNA | 2 |
| Vκ Primer Pool (9.1 μM) | 0.5 |
| pCALCK(G)L (20 μM) | 0.25 |
| Pfx50 | 0.50 |
| | 25 |

The PCR thermocycler conditions for Step II reactions were as follows:

1) 94° C. for 2 minutes
2) 35 cycles of:
94° C. for 15 seconds; 54° C. for 20 seconds; 68° C. for 1 minute
3) 68° C. for 3 minutes
4) 4° C. hold Following amplification, the PCR reaction products were separated on a 1% agarose gel and the band corresponding to the heavy chain (675 bp) and the light chain (650 bp) were purified by gel extraction (Qiagen Gel Extraction Kit; Cat. No. 28706). The PCR products were eluted in 30 μl.

TABLE 4

| Primers for Amplifying IgG Heavy Chain Genes | | |
|---|---|---|
| | Forward Primer Pool | SEQ ID NO |
| pCa130 VH1a | ggctttgctaccgtagcgCAGGCGGCCGCAC AGGTKCAGCTGGTGCAG | 42 |
| pCa130 VH1b | ggctttgctaccgtagcgCAGGCGGCCGCAC AGGTCCAGCTTGTGCAG | 43 |
| pCa130 VH1c | ggctttgctaccgtagcgCAGGCGGCCGCAS AGGTCCAGCTGGTACAG | 44 |
| pCa130 VH1d | ggctttgctaccgtagcgCAGGCGGCCGCAC ARATGCAGCTGGTGCAG | 45 |
| pCa130 VH2a | ggctttgctaccgtagcgCAGGCGGCCGCAC AGATCACCTTGAAGGAG | 46 |
| pCa130 VH3a | ggctttgctaccgtagcgCAGGCGGCCGCAG ARGTGCAGCTGGTGGAG | 47 |
| pCa130 VH4a | ggctttgctaccgtagcgCAGGCGGCCGCAC AGSTGCAGCTGCAGGAG | 48 |
| pCa130 VH4b | ggctttgctaccgtagcgCAGGCGGCCGCAC AGGTGCAGCTACAGCAG | 49 |
| pCa130 VH5a | ggctttgctaccgtagcgCAGGCGGCCGCAG ARGTGCAGCTGGTGCAG | 50 |
| pCa130 VH6 | ggctttgctaccgtagcgCAGGCGGCCGCAC AGGTACAGCTGCAGCAG | 51 |
| pCa130 VH7 | ggctttgctaccgtagcgCAGGCGGCCGCAC AGGTSCAGCTGGTGCAA | 52 |

TABLE 4-continued

| Primers for Amplifying IgG Heavy Chain Genes | | |
|---|---|---|
| | Reverse Primer Pool | SEQ ID NO |
| VHII-g1-Rev | TGCGGCCGGCCTGGCCGACCACAAGATTTGG GCTCAACTTTC | 53 |
| VHII-g2-Rev | TGCGGCCGGCCTGGCCGACCTTTGCGCTCAA CTGTCTTGTCC | 54 |
| VHII-g3-Rev | TGCGGCCGGCCTGGCCGACCTTTGAGCTCAA CTCTCTTGTCC | 55 |
| VHII-g4-Rev | TGCGGCCGGCCTGGCCGACCATATTTGGACT CAACTCTCTTG | 56 |

TABLE 5

| Primers for Amplifying Kappa Light Chain Genes | | |
|---|---|---|
| | Forward Primer Pool | SEQ ID NO |
| VK1a | AAggcccagccggccatggccgccggtGACAT CCAGATGACCCAG | 57 |
| VK1b | AAggcccagccggccatggccgccggtGACAT CCAGTTGACCCAG | 58 |
| VK1c | AAggcccagccggccatggccgccggtGCCAT CCGGTTGACCCAG | 59 |
| VK2a | AAggcccagccggccatggccgccggtGATAT TGTGATGACYCAG | 60 |
| VK3a | AAggcccagccggccatggccgccggtGAAAT TGTGTTGACGCAG | 61 |
| VK3b | AAggcccagccggccatggccgccggtGAAAT TGTGTTGACACAG | 62 |
| VK3c | AAggcccagccggccatggccgccggtGAAAT AGTGATGACGCAG | 63 |
| VK4a | AAggcccagccggccatggccgccggtGACAT CGTGATGACCCAG | 64 |
| VK5a | AAggcccagccggccatggccgccggtGAAAC GACACTCACGCAG | 65 |
| VK6a | AAggcccagccggccatggccgccggtGAAAT TGTGCTGACTCAG | 66 |
| VK6b | AAggcccagccggccatggccgccggtGATGT TGTGATGACACAG | 67 |
| | Reverse Primer | SEQ ID NO |
| pCALCK (G) L | CTCCTTATTAATTAATTAGCACTCTCCCCTGT TGAAGCTCTTTG | 68 |

TABLE 6

| Primers for Amplifying Lambda Light Chain Genes | | |
|---|---|---|
| | Forward Primer Pool | SEQ ID NO |
| VL1-F | AAGGCCCAGCCGGCCATGGCCGCCGGTGTTC AGTCTGTGCTGACKCAGCC | 69 |

TABLE 6-continued

| Primers for Amplifying Lambda Light Chain Genes | | |
|---|---|---|
| VL2-F | AAGGCCCAGCCGGCCATGGCCGCCGGTGTTC AGTCTGCCCTGACTCAGCC | 70 |
| VL3A-F | AAGGCCCAGCCGGCCATGGCCGCCGGTGTTT CCTATGAGCTGACWCAGCY | 71 |
| VL3B-F | AAGGCCCAGCCGGCCATGGCCGCCGGTGTTT CTTCTGAGCTGACTCAGGAC | 72 |
| VL3C-F | AAGGCCCAGCCGGCCATGGCCGCCGGTGTTT CCTATGWGCTGACTCAGCC | 73 |
| VL4A-F | AAGGCCCAGCCGGCCATGGCCGCCGGTGTTC TGCCTGTGCTGACTCAGCCC | 74 |
| VL4B-F | AAGGCCCAGCCGGCCATGGCCGCCGGTGTTC AGCYTGTGCTGACTCAATCR | 75 |
| VL5/9-F | AAGGCCCAGCCGGCCATGGCCGCCGGTGTTC AGSCTGTGCTGACTCAGCCR | 76 |
| VL6-F | AAGGCCCAGCCGGCCATGGCCGCCGGTGTTA ATTTTATGCTGACTCAGCCC | 77 |
| VL7/8-F | AAGGCCCAGCCGGCCATGGCCGCCGGTGTTC AGRCTGTGGTGACTCAGGAG | 78 |
| VL10-F | AAGGCCCAGCCGGCCATGGCCGCCGGTGTTC AGGCAGGGCTGACTCAGCCA | 79 |
| | Reverse Primer | SEQ ID NO |
| pCALCL(T)-R | CTCCTTATTAATTAATTATGAGCATTCTGYA KGGGCMAYTGTC | 80 |

Step III. Overlap PCR

In Step III, the heavy chain and light chain DNA segments generated in Step II were 1) linked in an overlap reaction with a Fab linker (see Table 7, below) that anneals to the 3' end of the light chain and the 5' end of the heavy chain and 2) amplified with a Sfi forward and reverse primers (see Table 7, below), thereby allowing amplification of a 1200 base pair (bp) antibody fragment containing the light chain-linker-heavy chain.

The Fab Kappa Linker was amplified from the 2g12/pCAL vector (SEQ ID NO:81). The PCR reaction conditions for the formation of the Fab Linker were as follows:

Fab Kappa Linker

| | |
|---|---|
| $H_2O$ | 19.75 |
| 10x buffer | 2.5 |
| dNTP (10 mM each) | 0.75 |
| 2g12/pCAL Vector (10 ng) | 1 |
| FabLinker-Fwd (20 μM) | 0.25 |
| FabLinker-Rev (20 μM) | 0.25 |
| Pfx50 | 0.5 |
| | 25 μL |

The Fab Lambda Linker was amplified from the 28d11/pCAL vector (SEQ ID NO:1638). The PCR reaction conditions for the formation of the Fab Lambda Linker were as follows:

Fab Lambda Linker

| Reagent | μL |
|---|---|
| $H_2O$ | 35.5 |
| 10x buffer | 5 |
| 10x enhancer | 5 |
| dNTP (10 mM each) | 1.5 |
| 28d11/pCAL Vector (10 ng) | 1 |
| FabLinkerCλ-Fwd (20 μM) | 0.5 |
| FabLinker-Rev IT* (20 μM) | 0.5 |
| Pfx50 | 0.5 |
| | 25 |

The PCR thermocycler conditions for the formation of the Fab Linkers were as follows:

1) 94° C. for 2 minutes
2) 30 cycles of:
94° C. for 15 seconds; 54° C. for 20 seconds; 68° C. for 1 minute
3) 68° C. for 3 minutes
4) 4° C. hold The PCR reaction was run on a 1% agarose gel and the 120 bp linker was gel extracted according to the Qiagen Gel Extraction protocol. 2 μl of the purified linker was used for each overlap reaction.

The PCR reaction conditions for Overlap were as follows (the Sfi F/R Primers are added to the PCR reaction after the first 15 cycles):

PCR III: Overlap

| Reagent | μL |
|---|---|
| $H_2O$ | 24.5 |
| 10x buffer | 5 |
| 10X Enhancer | 5 |
| dNTP (10 mM each) | 1.5 |
| Light Chain product | 5 |
| Heavy Chain product | 5 |
| Linker | 2 |
| Sfi F/R Primers (20 μM) | 1 |
| Pfx50 | 1 |
| | 50 |

The PCR thermocycler conditions were as follows:

1) 94° C. for 2 minutes
2) 15 cycles of:
94° C. for 15 seconds; 68° C. for 1 minute;
Add Sfi F/R Primers (1 μL), then:
3) 94° C. for 2 minutes
4) 30 cycles of:
94° C. for 15 seconds; 60° C. for 20 seconds; 68° C. for 2 minute
5) 68° C. for 3 minutes
6) 4° C. hold Following amplification, 10 μl of the total 50 μl PCR overlap reaction product light chain-linker-heavy chain was separated on a 1% agarose gel to determine the size and the remaining 40 μl of the PCR product was purified by the Qiagen PCR Purification Kit (Qiagen; Cat. No. 28106) into 30 μl total volume. Briefly, 5 times the PCR reaction volume of PBI buffer is added PCR product. The mix was bound to QIA Spin column and washed twice with PE buffer. The sample was eluted in 30 μl and spun for 1.5 minutes at top speed to elute all 30 μl. About 1 μg of overlap product was the typical yield per 50 μl overlap reaction.

TABLE 7

Step III Oligonucleotides

| | Oligonucleotide | SEQ ID NO |
|---|---|---|
| FabLinkerCK-Fwd | GAGCTTCAACAGGGGAGAGTGCTAATTAATTAATAAGGAG | 82 |
| FabLinker-Rev | TGCGGCCGCCTGCGCTACGGTAGCAAAGCCAGCCAGTGCCAC | 83 |
| FabLinkerCλ-Fwd | GACARTKGCCCMTRCAGAATGCTCATAATTAATTAATAAGGAGGATATAATTATGAAAAAG | 1639 |
| FabLinker-Rev-IT* | TGCGGCCGCCTACGCTACGGTAGCAAAGCCAGCCAGTGCCAC | 1640 |
| Sfi Forward | TCGCggcccagccggccatggc | 84 |
| Sfi Reverse | TGCGGCCGGCCTGGCCGA | 85 |

Step IV. Digestion with Sfi and Cloning into the pCAL Expression Vector or the pCAL IT* Expression Vector Following overlap PCR reaction and purification of the PCR product, the reaction product was digested with SfiI. To the 30 μl eluate (see above), the following was added for the digestion:

| | |
|---|---|
| 4 μl | Reaction buffer 2 (New England Biolabs) |
| 0.4 μl | BSA |
| 1.6 μl | SfiI enzyme (New England Biolabs) |
| 4 μl | $H_2O$ |
| 40 μl | Total Volume |

The reaction is incubated for 1 hour at 37° C. Following digestion, the digested overlap product was separated on a 1% agarose gel and the band corresponding to the antibody (~1.45 kB) was purified by gel extraction (Qiagen Gel Extraction Purification Kit Cat. No. 28706). Briefly, the gel slice was digested with 500 μl of buffer QC (Qiagen). 150 μl of isopropanol was added to digest and the sample was applied to the QiaSpin column. The column was washed twice with buffer PE (Qiagen) and the sample is eluted in 30 μl of EB buffer (Qiagen). About 15 ng/μl of digested sample is recovered from approximately 1 μg of PCR overlap product Finally, the digested overlap product was ligated into a pCAL bacterial expression vector (SEQ ID NO:86) or the pCAL IT* (SEQ ID NO:1641) bacterial expression vector. The ligation reaction conditions were as follows:

| | |
|---|---|
| 25 ng | SfiI digested pCAL or pCAL IT* vector |
| 25 ng | digested overlap product |
| 1 μl | T4 Ligase (NEB Cat. No. MC202L, 400,000 Units/ml) |

adjusted to 20 μl total volume with $H_2O$

The sample was ligated for 1 hour at room temperature. 1 μl of the ligation was diluted in 4 μl of $H_2O$ before proceeding to transformation.

Step V. Transformation into *E. coli*

Following ligation, the ligation product was transformed into DH5α Max Efficiency cells (Invitrogen; Cat No. 18258; Genotype: F-ϕ80lacZΔM15 Δ(lacZYA-argF) U169 recA1 endA1 hsdR17 (rk−, mk+) phoA supE44λ-thi-1 gyrA96 relA1). In short, 1 μl ligation product (⅕ dilution) was added to 50 μl DH5α and incubated on ice for 30 minutes. Transformation was effected by heat shock at 42° C. for 45 seconds followed by 2 minutes on ice. 0.9 mL SOC medium was added and the cells were allowed to recover at 37° C. for 1 hour with shaking. Cells were plated on LB plates supplemented with carbenicillin (100 μg/mL) and 20 mM glucose. The plates were incubated overnight at 37° C.

Step VI. Selection of Individual Colonies.

For each antibody amplification, a total of 88 individual colonies were selected and grown in 1 mL Super Broth (SB) supplemented with 1 carbenicillin (100 μg/mL) in a 96-well plate for 2 hours at 37° C. A daughter plate was generated by transferring 500 μl of each culture into another 96-well format bacterial plate with 500 μl of SB supplemented with 40 mM glucose (final 20 mM) and 100 ug/ml of carbenicillin. The original or mother plate was fed 500 μl of SB supplemented with 100 ug/ml carbenicillin. The original plate was grown at 30° C. overnight and the daughter plate (containing glucose) was grown at 37° C. overnight. The cell lysate from the 30° C. plate was used for bacterial ELISAs (see Example 4 below) and the 37° C. plate cultures were used for mini-prep DNA preparations (Qiagen).

SUMMARY

The five wells identified as hits were amplified using kappa light chain primers and cloned into the pCAL expression vector.

Example 3

Isolation of Anti-RSV Fab Antibodies by Single Cell Sorting

In this example, anti-RSV antibodies were isolated from CD19/CD27/IgG positive cells. The CD19/CD27/IgG positive cells were obtained by 1) B cell isolation; and 2) FACS single cell sorting. The sorted cells were then used to isolate RNA which served as a template for the in vitro production of Fab antibodies.

B Cell Isolation

B cells were isolated from PBMCs (harvested from an anonymous blood bank donor) using a B Cell Isolation Kit (Miltenyi Biotec, Cat. No. 130-091-151). The kit is used to isolate highly pure B cells by magnetic labeling and depletion of CD2, CD14, CD16, CD36, CD43, and CD235a-expressing cells (activated B cells, plasma cells and $CD5^+$ B-1a cells) and non-B cells (e.g., T cells, NK cells, dendritic cells, macrophages, granulocytes, and erythroid cells). According to the manufacturer's protocol, non-B cells were indirectly magnetically labeled by using a cocktail of biotin-conjugated monoclonal antibodies as a primary labeling reagent (Biotin-Antibody Cocktail) and anti-biotin monoclonal antibody conjugated to microbeads as a secondary labeling reagent (Anti-Biotin MicroBeads). The non-B cells were then removed from the pure resting B cells by magnetic separation.

Briefly, frozen PMBCs, obtained from Ficoll separation, were thawed, washed twice and counted. The cells were then centrifuged at 300 g for 10 minutes, and the supernatant was aspirated. The cell pellet was resuspended in 40 μl MACS buffer (per every $10^7$ cells) and 10 μl Biotin-Antibody Cocktail (per every $10^7$ cells) was added. Following thorough mixing, the cells were incubated at 4° C. for 10 minutes. After the incubation period, 30 μl buffer (per every $10^7$ cells) and 20 μl Anti-Biotin MicroBeads (per every $10^7$ cells) was added. Following thorough mixing, the cells were incubated at 4° C. for 15 minutes. The cells were then washed by adding 1-2 mL buffer (per every $10^7$ cells) followed by centrifuging at 300 g for 10 minutes and the supernatant was aspirated. Up to $10^8$ cells were then resuspended in 500 μl buffer.

Magnetic separation was effected by placing a LS column (composed of ferromagnetic spheres covered with a plastic coating to allow fast and gentle separation of cells) in the magnetic field of a MACS separator. The LS column was washed with 3 mL buffer and the cell suspension was applied to the top of the column. Unlabeled B cells were collected as they passed through the column after the addition of 3×3 mL buffer.

Single Cell Sorting

In this example, isolated B cells were sorted by antigen specificity using an FACSAria Flow Cytometer (BD Biosciences). Selected cells were CD19/CD27/IgG positive. RSV-F antigen was labeled with Alexa Fluor 647 following the manufacturers instruction (Molecular Probes, A-20186).

In short, the isolated B cells were aliquotted into 16 separate tubes. Fourteen tubes received $1\times10^5$ cells and were used to determine the photomultiplier settings and sort parameters on the FACSAria. The remaining $1.8\times10^6$ cells were labeled with Alexa Fluor 647/RSV-F at a final concentration of 20 nM. Labeled protein was added to the sample 15 minutes prior to the addition of antibodies. CD19 and CD27 antibodies were used at dilution of 1:20 while IgG antibody was used at a dilution of 1:50. Following the addition of Alexa Fluor 647/RSV-F protein and antibodies, the tubes were incubated on ice for 30 minutes and subsequently washed twice. Single cell sorting was effected using the FACSAria Flow Cytometer (BD Biosciences). The labels included PE-Cy5 (anti-human CD19), PE-Cy7 (anti-human CD27), PE (goat anti-human IgG Fcg), Pacific Blue (mouse anti-human CD3), FITC (mouse anti-human IgD, mouse anti-human IgM, mouse anti-human IgA and mouse anti-human CD14), propidium iodide and Alexa Fluor 647 (labeled RSV-F protein).

Cell sorting was performed by first excluding dead cells followed by exclusion of CD3 positive cells. CD19 and CD27 positive cells were further identified and within this population, cells were gated for IgG Fcγ expression. Cells expressing IgD, IgM and IgA were excluded from the remaining cells. Finally, CD19/CD27/IgG Fcγ positive cells were sorted for RSV-F binding and each positive B cell was deposited into an individual well of a 96 well plate containing 2 μl cDNA reaction buffer (Superscript III 10× buffer, Invitrogen; Cat No. 19090-051), 0.5 μl RNaseOUT and 7.5 μl sterile water. Plates were stored at −80° C. until further processed.

First Strand cDNA Synthesis

Following sorting, cDNA was generated individually in each well according to the Invitrogen First Strand Synthesis protocol. In short, 0.5 μl 10% NP-40, 1 μl oligo dT primer and 1 μl dNTPs were added to each well and the plate was incubated at 65° C. for 5 minutes followed by incubation on ice for 1 minute. Subsequently, 2 μl DTT, 4 μl $MgCl_2$ and 1 μl SuperScript III RT were added and the reaction mixture was incubated at 50° C. for 1 hour followed by incubation at 85° C. for 5 minutes. The cDNA was used immediately or frozen at −80° C. for long term storage.

IgG Heavy Chain and Kappa Light Chain Amplification

IgG heavy chains and kappa light chains were subsequently generated by four sequential steps of PCR.

Step 1. Amplification

In Step I, 2.5 μL cDNA generated by First Strand Synthesis (see above) was used as a template to individually amplify kappa light chains and IgG heavy chains by PCR. In this step, pools of Step I primers were utilized (see Tables 8 and 9 below). The reaction conditions were as follows:

PCR Step I:

| | |
|---|---|
| $H_2O$ | 16 |
| 10x buffer | 2.5 |
| 10x Enhancer buffer | 2.5 |
| dNTP (10 mM each) | 0.75 |
| cDNA | 2.5 |
| Step I pool(20 μM each) | 0.25 |
| Reverse Primer (20 μM) | 0.25 |
| Pfx50 | 0.25 |
| | 25 μL |

The PCR thermocycler conditions were as follows:

1) 94° C. for 2:00

2) 10 cycles of:

94° C. for 0:15; 62° C. for 0:20 (TOUCHDOWN); 68° C. for 1:00

3) 40 cycles of:

94° C. for 0:15; 52° C. for 0:20; 68° C. for 1:00

4) 68° C. for 3:00

5) 4° C. hold

The reaction mixtures were used as template DNA for Step II (see below) without any further purification.

TABLE 8

| Step I Primers for Amplifying Kappa Light Chains | | |
|---|---|---|
| Forward Primer Pool | | SEQ ID NO |
| 5′ LVκ1/2 | ATGAGGSTCCCYGCTCAGCTGCTGG | 87 |
| 5′ LVκ3 | CTCTTCCTCCTGCTACTCTGGCTCCCAG | 88 |
| 5′ LVκ4 | ATTTCTCTGTTGCTCTGGATCTCTG | 89 |
| Reverse Primer | | SEQ ID NO |
| VK-Rev | GCACTCTCCCCTGTTGAAGCTCTTTG | 90 |

TABLE 9

| Step I Primers for Amplifying IgG Heavy Chains | | |
|---|---|---|
| Forward Primer Pool | | SEQ ID NO |
| 5′ L-VH1 | ACAGGTGCCCACTCCCAGGTGCAG | 91 |
| 5′ L-VH3 | AAGGTGTCCAGTGTGARGTGCAG | 92 |
| 5′ L-VH4/6 | CCCAGATGGGTCCTGTCCCAGGTG CAG | 93 |
| 5′ L-VH5 | CAAGGAGTCTGTTCCGAGGTGCAG | 94 |
| Reverse Primer | | SEQ ID NO |
| 3′ CγCH1 | GGAAGGTGTGCACGCCGCTGGTC | 95 |

Step II. Amplification

In Step II, the reaction mixtures from Step I were used as templates for second PCR reactions with pools of forward and reverse primers for either the light chain or heavy chain, respectively. These reactions amplified the DNA from the framework 1 region of each chain. The light chain forward primers (see Table 10) were designed to introduce a SfiI restriction site (SEQ ID NO:41). The reaction conditions were as follows:

PCR II: Light Chain

| | |
|---|---|
| $H_2O$ | 15.75 |
| 10x buffer | 2.5 |
| 10X Enhancer | 2.5 |
| dNTP (10 mM each) | 0.75 |
| Step I reaction | 2.5 |
| Vk Primer Pool (9.1 μM) | 0.5 |
| pCALCK(G)L (20 μM) | 0.25 |
| Pfx50 | 0.25 |
| | 25 μL |

The heavy chain forward primers (see Table 11) were designed to introduce a SalI restriction site (SEQ ID NO:96). The reaction conditions were as follows:

PCR II: Heavy Chain

| | |
|---|---|
| $H_2O$ | 14.25 |
| 10x buffer | 2.5 |
| 10X Enhancer | 2.5 |
| dNTP (10 mM each) | 0.75 |
| Step I reaction | 2.5 |
| pCAL24VH-F pool (2 μM) | 2 |
| SalI JH-Rev pool (20 μM) | 0.25 |
| pfx50 | 0.25 |
| | 25 μL |

The PCR thermocycler conditions were as follows:

1) 94° C. for 2 minutes 2) 50 cycles of:

94° C. for 15 seconds; 54° C. for 20 seconds; 68° C. for 1 minute 3) 68° C. for 3 minutes 4) 4° C. hold Following amplification, the PCR reaction products were separated on a 1% agarose gel and the band corresponding to the heavy chain (400 bp) and the light chain (650 bp) were purified by gel extraction (Qiagen).

TABLE 10

| Primers for Amplifying Kappa Light Chains | | |
|---|---|---|
| Forward Primer Pool | | SEQ ID NO |
| VK1a | AAggcccagccggccatggccgccggtGAC ATCCAGATGACCCAG | 57 |
| VK1b | AAggcccagccggccatggccgccggtGAC ATCCAGTTGACCCAG | 58 |
| VK1c | AAggcccagccggccatggccgccggtGCC ATCCGGTTGACCCAG | 59 |
| VK2a | AAggcccagccggccatggccgccggtGAT ATTGTGATGACYCAG | 60 |
| VK3a | AAggcccagccggccatggccgccggtGAA ATTGTGTTGACGCAG | 61 |
| VK3b | AAggcccagccggccatggccgccggtGAA ATTGTGTTGACACAG | 62 |
| VK3c | AAggcccagccggccatggccgccggtGAA ATAGTGATGACGCAG | 63 |
| VK4a | AAggcccagccggccatggccgccggtGAC ATCGTGATGACCCAG | 64 |

TABLE 10-continued

| Primers for Amplifying Kappa Light Chains | | |
|---|---|---|
| VK5a | AAggcccagccggccatggccgccggtGAA ACGACACTCACGCAG | 65 |
| VK6a | AAggcccagccggccatggccgccggtGAA ATTGTGCTGACTCAG | 66 |
| VK6b | AAggcccagccggccatggccgccggtGAT GTTGTGATGACACAG | 67 |
| | Reverse Primer | SEQ ID NO |
| pCALCK (G) L | CTCCTTATTAATTAATTAGCACTCTCCCCT GTTGAAGCTCTTTG | 68 |

TABLE 11

| Primers for Amplifying IgG Heavy Chains | | |
|---|---|---|
| | Forward Primer Pool | SEQ ID NO |
| pCa130 VH1a | ggctttgctaccgtagcgCAGGCGGCCGCA CAGGTKCAGCTGGTGCAG | 42 |
| pCa130 VH1b | ggctttgctaccgtagcgCAGGCGGCCGCA CAGGTCCAGCTTGTGCAG | 43 |
| pCa130 VH1c | ggctttgctaccgtagcgCAGGCGGCCGCA SAGGTCCAGCTGGTACAG | 44 |
| pCa130 VH1d | ggctttgctaccgtagcgCAGGCGGCCGCA CARATGCAGCTGGTGCAG | 45 |
| pCa130 VH2a | ggctttgctaccgtagcgCAGGCGGCCGCA CAGATCACCTTGAAGGAG | 46 |
| pCa130 VH3a | ggctttgctaccgtagcgCAGGCGGCCGCA GARGTGCAGCTGGTGGAG | 47 |
| pCa130 VH4a | ggctttgctaccgtagcgCAGGCGGCCGCA CAGSTGCAGCTGCAGGAG | 48 |
| pCa130 VH4b | ggctttgctaccgtagcgCAGGCGGCCGCA CAGGTGCAGCTACAGCAG | 49 |
| pCa130 VH5a | ggctttgctaccgtagcgCAGGCGGCCGCA GARGTGCAGCTGGTGCAG | 50 |
| pCa130 VH6 | ggctttgctaccgtagcgCAGGCGGCCGCA CAGGTACAGCTGCAGCAG | 51 |
| pCa130 VH7 | ggctttgctaccgtagcgCAGGCGGCCGCA CAGGTSCAGCTGGTGCAA | 52 |
| | Reverse Primer Pool | SEQ ID NO |
| 3' SalIJH 1/2/4/5 | TGCGAAGTCGACGCTGAGGAGACGGTGACC AG | 97 |
| 3' SalIJH3 | TGCGAAGTCGACGCTGAAGAGACGGTGACC ATTG | 98 |
| 3' SalIJH6 | TGCGAAGTCGACGCTGAGGAGACGGTGACC GTG | 99 |

Step III. Overlap PCR

In Step III, the heavy chain and light chain DNA segments generated in step II were: 1) linked in an overlap reaction with a Fab linker (see Table 12, below) that anneals to the 3' end of the light chain and the 5' end of the heavy chain and 2) amplified with a Sfi forward primer (see Table 12, below) that anneals to the 5' end of the light chain and JH reverse primers (see Table 11, above) that anneal to the 3' end of the heavy chain, thereby allowing amplification of a 1200 base pair (bp) antibody fragment containing the light chain-linker-heavy chain. The reaction conditions were as follows (the linker was generated as described in Example 2 above):

| | |
|---|---|
| $H_2O$ | 24.5 |
| 10x buffer | 5 |
| 10X Enhancer | 5 |
| dNTP (10 mM each) | 1.5 |
| Light Chain | 5 |
| Heavy Chain | 5 |
| Linker | 2 |
| Sfi F/JH-R Primers (20 μM) | 1 |
| pfx50 | 1 |
| | 50 μL |

The PCR thermocycler conditions were as follows:

Overlap with Linker 1) 94° C. for 2 minutes 2) 15 cycles of:

94° C. for 15 seconds; 68° C. for 1 minute

Add primers 3) 94° C. for 2 minutes 4) 30 cycles of:

94° C. for 15 seconds; 60° C. for 20 seconds; 68° C. for 1 minute 5) 68° C. for 3 minutes 6) 4° C. hold Following amplification, the PCR reaction product light chain-linker-heavy chain was separated on a 1% agarose gel and was purified by gel extraction (Qiagen).

Step IV. Introduction of $C_H1$ Region

Following overlap, the amplified light chain-linker-heavy chain was digested with Sal I and ligated to a Sal1 digested heavy chain constant region 1 (CHγ1 region) introducing a SfiI restriction site at the 3' end of the heavy chain constant region. The ligation reaction conditions were as follows:

2 μl of Ligation reaction buffer

2 μl of $C_H1$

5 μl of 1.2 kB gel purified product from step III

10 μl of water

1 μl T4 Ligase

The ligation reaction mixture was incubated for 30 minutes at room temperature.

Following ligation, the full length Fab was amplified by PCR with SfiI Forward and Reverse primers (see Table 12, below) resulting in a 1.45 kb fragment. The reaction conditions were as follows:

| | |
|---|---|
| $H_2O$ | 31.5 |
| 10x buffer | 5 |
| 10X Enhancer | 5 |
| dNTP (10 mM each) | 1.5 |
| Ligation reaction mixture | 5 |
| Sfi F/R Primers (20 μM) | 1 |
| pfx50 | 1 |
| | 50 μL |

The PCR thermocycler conditions were as follows:

1) 94° C. for 2 minutes 2) 30 cycles of:

94° C. for 15 seconds; 60° C. for 20 seconds; 68° C. for 1 minute 3) 68° C. for 3 minutes 4) 4° C. hold The reaction product was a 1.45 kB fragment of a light chain and heavy chain linked together in a single cassette.

TABLE 12

Step III and Step IV Oligonucleotides

| | Oligonucleotide | SEQ ID NO |
|---|---|---|
| Fab Linker | GAGCTTCAACAGGGGAGAGTGCTAATTAATTAATAAGGAGGatataattatgaaaaagacagctatcgcgattgcaGTGGCACTGGCTGGCTTTGCTACCGTAGCGCAGGCGGCCGCA | 100 |
| Sfi Forward | TCGCggcccagccggccatggc | 84 |
| Sfi Reverse | TGCGGCCGGCCTGGCCGA | 85 |
| CH1 fragment | gtcgaccaaaggtccgtctgttttcccgctggctccgtcttctaaatctacctctggtggtaccgctgctctgggttgcctggttaaagactacttcccggaaccggttaccgtttcttggaactctggtgctctgacctctggtgttcacaccttcccggctgttctgcagtcttctggtctgtactctctgtcttctgttgttaccgttccgtcttcttctctgggtacccagacctacatctgcaacgttaaccacaaaccgtctaacaccaaagttgacaagaaagttgaaccgaaatcttgcctgcgatcgcggccaggccggccgcaccatcaccatcaccatggcgcatacccgtacgacgttccggactacgcttctactagt | 101 |

Step V. Digestion with Sfi and Cloning into pCAL Expression Vector

Following overlap PCR reaction and purification of the PCR product, the reaction product was digested with SfiI. To the 30 µl eluate (see above), the following was added for the digestion:

| | |
|---|---|
| 4 µl | Reaction buffer 2 (New England Biolabs) |
| 0.4 µl | BSA |
| 1.6 µl | SfiI enzyme (New England Biolabs) |
| 4 µl | $H_2O$ |
| 40 µl | Total Volume |

The reaction is incubated for 1 hour at 37° C. Following digestion, the digested overlap product was separated on a 1% agarose gel and the band corresponding to the antibody (~1.45 kB) was purified by gel extraction (Qiagen Gel Extraction Purification Kit Cat. No. 28706). Briefly, the gel slice was digested with 500 µl of buffer QC (Qiagen). 150 µl of isopropanol was added to digest and the sample was applied to the QiaSpin column. The column was washed twice with buffer PE (Qiagen) and the sample is eluted in 30 µl of EB buffer (Qiagen). About 15 ng/µl of digested sample is recovered from approximately 1 µg of PCR overlap product Finally, the digested overlap product was ligated into a pCAL bacterial expression vector (SEQ ID NO:86). The ligation reaction conditions were as follows:

| | |
|---|---|
| 25 ng | SfiI digested pCAL vector |
| 25 ng | digested overlap product |
| 1 µl | T4 Ligase (NEB Cat. No. MC202L, 400,000 Units/ml) |
| 20 µl | total volume |

The sample was ligated for 1 hour at room temperature. 1 µl of the ligation was diluted in 4 µl of $H_2O$ before proceeding to transformation.

Step VI. Transformation into *E. coli*

Following ligation, the ligation product was transformed into DH5α Max Efficiency cells (Invitrogen; Cat No. 18258; Genotype: F-ϕ80lacZΔM15 Δ(lacZYA-argF) U169 recA1 endA1 hsdR17 (rk−, mk+) phoA supE44λ-thi-1 gyrA96 recA1). In short, 1 µl ligation product (⅕ dilution) was added to 50 µl DH5α and incubated on ice for 30 minutes. Transformation was effected by heat shock at 42° C. for 45 seconds followed by 2 minutes on ice. 0.9 mL SOC medium was added and the cells were allowed to recover at 37° C. for 1 hour with shaking. Cells were plated on LB plates supplemented with carbenicillin (100 µg/mL) and 20 mM glucose. The plates were incubated overnight at 37° C.

Step VII. Selection of Individual Colonies.

A total of 88 individual colonies were selected and grown in 1 mL Super Broth (SB) supplemented with 1 carbenicillin (100 µg/mL) in a 96-well plate for 2 hours at 37° C. A daughter plate was generated by transferring 500 µl of each culture into another 96-well format bacterial plate with 500 µl of SB supplemented with 40 mM glucose (final 20 mM) and 100 µg/ml of carbenicillin. The original or mother plate was fed 500 µl of SB supplemented with 100 ug/ml carbenicillin. The original plate was grown at 30° C. overnight and the daughter plate (containing glucose) was grown at 37° C. overnight. The cell lysate from the 30° C. plate was used for bacterial ELISAs (see Example 4 below) and the 37° C. plate cultures were used for mini-prep DNA preparations (Qiagen).

Example 4

Antibody Binding to RSV F Protein

In this example, Fab antibodies generated in Examples 2 and 3 were tested for their ability to bind to purified RSV F1 lysate by ELISA. Briefly, 50 µL bacterial cell lysate diluted 1 volume into 3 volumes total with PBS/3% BSA/0.01% Tween20 was added to a 96-well ELISA plate previously coated with RSV F1 lysate (see Example 1, above). The plate was incubated at 37° C. for 2 hours, or alternatively at 4° C. overnight, followed by washing 4× with wash buffer (PBS/0.05% Tween20). 50 µL goat anti-human IgG F(ab)-HRP antibody (Jackson Labs Cat. No. 109-036-097) diluted 1:1000 in PBS/3% BSA/0.01% Tween20 was added and the plate was incubated at 37° C. for 1 hour. Following washing 6× with wash buffer, 50 µL 1:1 v/v TMB:peroxide solution (Pierce, Cat No. 34021) was added and allowed to develop for 7 minutes. The reaction was immediately halted by the addition of 50 µL 2N $H_2SO_4$ and the absorbance at 450 nm was measured using an ELISA plate reader. Positive binding was indicated by an $OD_{450}$ greater than 0.5 (0.5-0.9 is moderate binding, >1 is strong binding) and a response that was 3-fold above background.

In addition to binding to RSV F1 lysate, several positive and negative control antigens were also utilized. Plasma from a pool of Blood Bank donors (collected and frozen after Ficoll Hypaque separation, diluted 1:1000) was used as a positive control for RSV F1 lysate binding. As a positive control to determine that each bacterial cell lysate contains an intact Fab, an Affinipure goat anti-human $F(ab)_2$ antibody (1 µg/ml Jackson Immunoresearch Cat. No. 109-006-097) was used to coat a 96-well ELISA plate to capture intact Fab. This antibody binds only to the F(ab) portion of an IgG antibody. Fab expression was then detected by using anti-HA Peroxidase (Roche, Cat. #12013819001; the bacterial expressed Fabs have an HA-tag). Actin (1 µg/ml, Sigma Cat. No. A3653) was used as a negative control for Fab binding to any protein and as a positive control for the ELISA reaction using mouse anti-actin antibody (1.25 μg/ml, Sigma Cat. No. A3853) and goat anti-mouse IgG F(ab)-HRP antibody (Santa Cruz Biotech Cat. No. SC3697). The mouse anti-RSV mAb (clone 2F7, mouse ascites fluid, Cat. No. ab43812, Abcam) was also included as negative control for specificity of binding to the RSV F protein since this antibody was employed to bind RSV F protein to the ELISA plate and thus was present on the ELISA plates during screening of the human anti-RSV antibodies.

A. Binding of Cell Lysates for Fabs Generated from EBV-Transformed B Cells (See Example 2)

Eighty-eight (88) cell lysates generated in Example 2 above were tested by ELISA for their ability to 1) bind to an anti-Fab antibody; and 2) bind RSV F1 lysate. ELISA confirmed that 76 of 88 cell lysates were positive for Fab production while 59 of the 88 cell lysates bound RSV F lysate. Confirmation ELISA revealed that 72 of the 76 cell lysates were indeed producing Fab and 46 of the initial 59 positive hits were reconfirmed as binders to RSV F lysate.

Three of the positive binders were identified by DNA sequencing of the corresponding DNA prep. Sequencing revealed they all had the same sequence, identified as Fab 58c5, which has the following light and heavy chains:

Fab 58c5

Light Chain (SEQ ID NO: 5)

EIVMTQSPSSLSASIGDRVTITCQASQDISTYLNWYQQKPGQAPRLL

IYGASNLETGVPSRFTGSGYGTDFSVTISSLQPEDIATYYCQQYQYL

PYTFAPGTKVEIKRTVAAPSVFIFPPSDEQLKSGTASVVCLLNNFYP

REAKVQWKVDNALQSGNSQESVTEQDSKDSTYSLSSTLTLSKADYEK

HKVYACEVTHQGLSSPVTKSFNRGEC

Heavy Chain (SEQ ID NO: 1)

QVQLVQSGPGLVKPSQTLALTCNVSGASINSDNYYWTWIRQRPGGGL

EWIGHISYTGNTYYTPSLKSRLSMSLETSQSQFSLRLTSVTAADSAV

-continued

YFCAACGAYVLISNCGWFDSWGQGTQVTVSSASTKGPSVFPLAPSSK

STSGGTAALGCLVKDYFPEPVTVSWNSGALTSGVHTFPAVLQSSGLY

SLSSVVTVPSSSLGTQTYICNVNHKPSNTKVDKKVEPKSC

B. Binding of Cell Lysates for Fabs Generated from Single Cell Sorting (See Example 3)

The results indicated that 64 of 88 cell lysates generated in Example 3 bound RSV F1 protein. Twenty four positive binders were identified by DNA sequencing of the corresponding DNA prep.

One of the positive binders identified was Fab sc5 which has the following light and heavy chains:

Fab sc5

Light Chain (SEQ ID NO: 13)

DIQMTQSPSSLSASVGDRVTITCRASQNIKNYLNWYQQKPGKVPKLL

IYAASTLQSGVPSRFSGSGSGTDFTLTISSLQPEDFATYSCQQSYNN

QLTFGGGTKVEIKRTVAAPSVFIFPPSDEQLKSGTASVVCLLNNFYP

REAKVQWKVDNALQSGNSQESVTEQDSKDSTYSLSSTLTLSKADYEK

HKVYACEVTHQGLSSPVTKSFNRGEC

Heavy Chain (SEQ ID NO: 9)

QVQLQESGPGLVKPSGTLSLTCTVSGDSISGSNWWNWVRQPPGKGLE

WIGEIYYRGTTNYKSSLKGRVTMSVDTSKNQFSLKLTSVTAADTAVY

YCARGGRSTFGPDYYYYMDVWGRGTTVTVSSASTKGPSVFPLAPSSK

STSGGTAALGCLVKDYFPEPVTVSWNSGALTSGVHTFPAVLQSSGLY

SLSSVVTVPSSSLGTQTYICNVNHKPSNTKVDKKVEPKSC

The antibody domains and CDR regions of isolated 58c5 and sc5 Fabs are provided in Table 13A-13B below.

TABLE 13A

Antibody domains and CDR regions of isolated Fabs

| Ab | VH chain | VH domain | VH CDR1 | VH CDR2 | VH CDR3 |
|---|---|---|---|---|---|
| 58c5 | SEQ ID NO: 1 | Amino acids 1-125 of SEQ ID NO: 1 | GASINSDNYYWT (SEQ ID NO: 2) | HISYTGNTYYTPSLKS (SEQ ID NO: 3) | CGAYVLISNCGWFDS (SEQ ID NO: 4) |
| sc5 | SEQ ID NO: 9 | Amino acids 1-125 SEQ ID NO: 9 | GDSISGSNWWN (SEQ ID NO: 10) | EIYYRGTTNYKNSLKG (SEQ ID NO: 11) | GGRSTFGPDYYYYMDV (SEQ ID NO: 12) |
| | VL chain | VL domain | VL CDR1 | VL CDR2 | VL CDR3 |
| 58c5 | SEQ ID NO: 5 | Amino acids 1-107 of SEQ ID NO: 5 | QASQDISTYLN (SEQ ID NO: 6) | GASNLET (SEQ ID NO: 7) | QQYQYLPYT (SEQ ID NO: 8) |
| sc5 | SEQ ID NO: 13 | Amino acids 1-107 of SEQ ID NO: 13 | RASQNIKNYLN (SEQ ID NO: 14) | AASTLQS (SEQ ID NO: 15) | QQSYNNQLT (SEQ ID NO: 16) |

TABLE 13B

| Heavy chain CDR1 (Kabat numbering) | | | |
|---|---|---|---|
| Ab | VH CDR1 | Ab | VH CDR1 |
| 58C5 | SDNYYWT (SEQ ID NO: 1627) | sc5 | GSNWWN (SEQ ID NO: 1628) |

Example 5

Expression and Purification of Isolated Fabs

In this example, individual Fab antibodies that were determined to bind RSV F lysate by ELISA using cell lysate were subsequently expressed and purified from the bacterial cells using column chromatography.

The DNA encoding each individual Fab antibody was transformed into Top10 cells (Invitrogen) for expression. Each Fab antibody was grown in 2 L SB at 37° C. to an $OD_{600}$ of 0.8. Protein expression was induced by the addition of 1 mM IPTG and allowed to occur overnight at 30° C. Following expression, the bacterial cultures were centrifuged and the cell pellet was resuspended in 10 mL Phosphate Buffered Saline (PBS) with protease inhibitors (Complete Protease Inhibitor Cocktail, Santa Cruz Biotech, Cat. #sc-29131). Lysozyme (0.2 mg) was added to the resuspended cells and the mixture was incubated at room temperature for 15 minutes. The cells were lysed by two freeze/thaw cycles. In short, the resuspended bacterial cells were frozen in an ethanol/dry ice bath followed by thawing in a 37° C. water bath. Once lysed, the bacterial lysate was centrifuged at 18000 rpm and the supernatant was filtered and sterilized by passing through a 0.4 micron filter.

Each individual Fab antibody was then purified by affinity column chromatography. In short, the filtered supernatant was passed slowly over an anti-Fab/Protein A column allowing the Fab protein to bind. Following washing with 50 mL PBS, the bound Fab was eluted with 9 mL of 0.2 M glycine, pH 2.2 and collected in a conical tube containing 1 mL of 2M Tris, thereby neutralizing the eluted protein. The eluted Fab was then dialyzed using a 10K MWCO dialysis cassette (Pierce) against 4 L PBS. The protein was stored at 4° C. overnight and subsequently concentrated to a volume of 1 mL using a 10 kDa Amicon Ultra Filter (Millipore). Binding of each purified Fab antibody to RSV F lysate (recombinant source, Example 1A) and HEp2 lysate (native source, Example 1B) was then reconfirmed by ELISA (see Example 4 above). Additionally, each purified Fab antibody was tested for its ability to neutralize RSV using the assay described in Example 6.

Binding of Fabs 58c5 and sc5 to RSV F Lysate and Purified RSV F Protein

The binding of antibodies 58C5 and sc5 to either captured RSV F protein from transfected 293 cells (recombinant) or purified RSV F protein from RSV A2 infected Hep2 cells (native) was measured by ELISA. The results indicate that Fab 58c5 and Fab sc5 bind to RSV F protein (recombinant) in a dose dependent manner but only sc5 was able to recognize the purified F protein (native) (see Tables 14-15 below).

TABLE 14

| Binding of Fab sc5 and 58c5 to captured RSV F lysate (recombinant) | | |
|---|---|---|
| Fab [μg/ml] | sc5 | 58c5 |
| 2 | 2.963 | 2.9165 |
| 0.4 | 2.827 | 2.9705 |
| 0.08 | 2.151 | 2.518 |
| 0.016 | 0.651 | 1.433 |
| 0.0032 | 0.3205 | 0.5905 |
| 0.00064 | 0.284 | 0.415 |
| 0.000128 | 0.337 | 0.3785 |
| 0.0000256 | 0.22 | 0.2485 |

TABLE 15

| Binding of Fab sc5 and 58c5 to purified RSV-F Protein (native) | | |
|---|---|---|
| Fab [μg/ml] | sc5 | 58c5 |
| 2 | 2.623 | 0.417 |
| 0.4 | 2.704 | 0.2665 |
| 0.08 | 2.744 | 0.1505 |
| 0.016 | 2.66 | 0.098 |
| 0.0032 | 1.7685 | 0.0805 |
| 0.00064 | 0.6035 | 0.087 |
| 0.000128 | 0.2325 | 0.1065 |
| 0.0000256 | 0.1445 | 0.13 |

Example 6

RSV Neutralization Assay

In this example, the anti-RSV antibodies were analyzed for their ability to bind to and neutralize RSV virus in solution as assessed by a plaque reduction assay. In this experiment, the RSV virus and the antibodies were pre-incubated in the absence of target cells. The mixture was then added to the cells and virus infection was measured by a standard plaque reduction assay described herein. The anti-RSV antibodies were analyzed for their ability to neutralize several strains of RSV virus, including RSV A2 (ATCC Cat. No. VR-1540), RSV B-wash (ATCC Cat. No. VR-1580, strain 18537), and RSV B-1 (ATCC Cat. No. 1400).

Vero cells (ATCC, cat no: CCL-81; Manassas, Va.) were employed for host cell infection. Vero cells were grown in DMEM (HyClone, cat no: SH 30285.01) with 10% fetal bovine serum (FBS) (HyClone, cat no: SH30070.03), supplemented with 1% L-Glutamine (HyClone, cat no: SH30034.01) and 1% Penicillin-Streptomycin solution (HyClone, cat no: SV30010). The Vero cells were maintained in a 37° C. incubator with 5% CO2 and passaged twice per week.

On day 1 of the experiment, Vero cells were cultured in 24-well cell culture plates. The cells were plated at a density (approximately $1\times10^6$ cells per well) which allows formation of a cell monolayers (>90% confluence) by day 2. On day 2, each antibody was serially diluted in plain Eagle's minimal essential medium (EMEM, ATCC, cat no: 30-2003) (final antibody concentrations tested: 20 μg/ml, 4 μg/ml, 0.8 μg/ml, 0.16 μg/ml, 0.032 μg/ml, and 0.006 μg/ml). The RSV virus was also diluted in plain EMEM to a concentration of $2\times10^3$ pfu/ml (100 pfu/50 ul) and 110 μl of the diluted RSV virus was added to 110 μl of each diluted antibody solution and mixed by pipetting. For the virus control sample, 110 μl of the diluted RSV virus was added to 110 μl plain EMEM. The antibody-virus or virus control mixtures were incubated at 37° C. for 2 hours. Following incubation, the culture media was decanted from the 24-well cell culture plates containing the Vero host cells and 100 μl of the pre-incubated virus-antibody or virus control mixture was then transferred to each well. Each test and control sample was prepared in triplicate. The cells were then incubated at 37° C. for one hour with mixing every 15 min.

Following the incubation period, the culture media containing the virus-antibody or virus control mixture was aspirated and 1 ml of overlay medium was added to each well (overlay medium contained EMEM, 2% FBS, 1% L-glutamine, 0.75% methylcellulose). The 24-well cell culture plates were then incubated at 37° C. (with 5% $CO_2$) for approximately 72 hours. Cell plates were fixed with 10% formalin for 1 hour at room temperature, washed 10 times with $ddH_20$ and blocked with 5% non-fat dry milk (NFDM) in PBS with 0.05% Tween 20) at 37° C. for one hour.

Following incubation, the blocking solution was decanted and 200 μL of mouse anti-RSV antibody (ab10018, Abcam, 1:1000 dilution in 5% NFDM) was added to each well. The plates were incubated at 37° C. for 2 hrs, washed 10 times with $ddH_20$ and 200 μL of goat anti-mouse HRP-conjugated IgG (Pierce, Cat. No. 31432, 1:1000 dilution in 5% NFDM) was added to each well. The plates were incubated at 37° C. for 2 hrs. The plates were washed 10 times with $ddH_2O$ and 200 μL of TrueBlue™ peroxidase substrate (KPL Cat. No. 50-78-02) was added to each well. The plates were developed for 10 min at room temperature. The plates were washed twice with ddH20 and dried on a paper towel and the number of blue plaques was counted. The ED50 (effective dilution for 50% neutralization) was calculated using Prism (GraphPad). The plaque reduction rate was calculated according to the following formula:

Plaque Reduction Rate(percentile)=(1−average plaque number in each antibody dilution/average plaque number in virus control wells)*100

The data is shown in Tables 16-18 below. Table 16 lists the $ED_{50}$ for each Fab for the various RSV strains. Table 17 lists the plaque counts for the various RSV strains and at the varying concentrations for Fab 58c5. Table 18 lists the plaque reduction rate for Fab 58c5. The results indicate Fab 58c5 is capable of neutralizing all 3 strains of RSV while Fab sc5 neutralizes only RSV A2 and RSV B-1, albeit at much higher antibody concentrations. Based on the data obtained in the neutralization assay and the molecular weight of the Fab 58c5 fragment (approximately 50 kDa), the EC50 of Fab 58c5 for in vitro neutralization of RSV was estimated to be approximately 320 pM.

TABLE 16

Neutralization Data ED50 for Fab 58c5 and Fab sc5

| Antigen | Fab 58c5 ED50 | Fab sc5 ED50 |
|---|---|---|
| RSV A2 | 320 pM | 0.016 μM |
| | (0.016 μg/mL) | (0.8 μg/mL) |
| RSV B/wash | 500 pM | >0.2 μM |
| | (0.025 μg/mL) | (>10 μg/mL) |
| RSV B-1 | 840 pM | 0.042 μM |
| | (0.042 μg/mL) | (2.1 μg/mL) |

TABLE 17

Average Plaque Count for Neutralization with Fab 58c5

| Antigen | 10 ug/ml | 2 ug/ml | 0.4 ug/ml | 0.08 ug/ml | 0.016 ug/ml | 0.003 ug/ml | 0 ug/ml |
|---|---|---|---|---|---|---|---|
| RSV A2 | 0 | 0 | 0 | 5.7 | 28.7 | 52.3 | 57.7 |
| RSV B/wash | 1.3 | 0.7 | 0 | 5 | 16.3 | 23.3 | 26.3 |
| RSV B-1 | 0.3 | 0 | 0 | 4.7 | 8.7 | 11.7 | 12.3 |

TABLE 18

Plaque reduction rate (%) for Neutralization with Fab 58c5

| Antigen | 10 ug/ml | 2 ug/ml | 0.4 ug/ml | 0.08 ug/ml | 0.016 ug/ml | 0.003 ug/ml | 0 ug/ml |
|---|---|---|---|---|---|---|---|
| RSV A2 | 100 | 100 | 100 | 90 | 50 | 9.4 | 0 |
| RSV B/wash | 95 | 97 | 100 | 81 | 38 | 11 | 0 |
| RSV B-1 | 97.6 | 100 | 100 | 62 | 29 | 5 | 0 |

Example 7

Cloning and Expression of IgG

In this example, Fab antibodies that showed potential to neutralize RSV were converted into IgGs by cloning into the pCALM mammalian expression vector (SEQ ID NO:102). Primers specific to each antibody were generated and the heavy and light chains of each Fab as originally cloned into the pCAL vector (see Example 2) were amplified by PCR. Light chain amplification resulted in an 650 bp fragment and heavy chain amplification resulted in a 400 bp fragment. Additionally, a linker was generated that allowed overlap of the heavy chain and the light chain. The linker also included a standard heavy chain constant region. Overlap of the heavy and light chains resulted in a 2.1 kB cassette for each antibody that had SfiI restriction sites (SEQ ID NO:41) at both ends. Each cassette was digested with SfiI and cloned into the pCALM vector. After confirmation of the correct sequence in bacteria, DNA for mammalian transfections was isolated using a Maxi Prep Kit (Qiagen).

To express each IgG, each pCALM vector was used to infect about 200 million 293F cells resulting in about 200 micrograms of IgG. The 293F cells were transfected with 293fectin (Invitrogen, Cat. No. 51-0031) and allowed to produce IgG for 72 hours. After 72 hours post transfection, the cell media was harvested, centrifuged to remove the cells, and filter sterilized through a 0.4 micron filter unit. Purification was effected by column chromatography using a Protein A column. The filtered media, containing the expressed IgG, was passed twice through a Protein A column. Following washing with 50 mL of PBS, IgG was eluted with 9 mL of 0.2 M glycine at pH 2.2 and collected in 2 M Tris to effect neutralization. The elute was dialyzed against 4 liters of PBS using a 10 kDa dialysis cassette (Pierce). The sample was concentrated down to 1 mL with a 10 kDa Amicon Ultra (Millipore).

Example 8

IgG Binding Assays

In this example, the IgG form of 58c5, generated as described in Example 7 above, and anti-RSV antibody Motavizumab (Wu et al. (2007) *J. Mol. Biol.* 368(3):652-665)

were tested for their ability to bind to RSV F protein (recombinant) or RSV F protein (native) lysate by ELISA (see Example 4 above). The estimated $EC_{50}$s for binding (determined by titrating each IgG) are set forth in Table 19 below. The IgG form of 58c5 has an affinity for RSV strain A2 F protein about the same as motavizumab.

TABLE 19

| IgG Binding to RSV F Protein | |
|---|---|
| Antigen | IgG $EC_{50}$ (estimated) |
| IgG form of 58c5 | 24 pM |
| Motavizumab | 27 pM |

Example 9

IgG Form of 58c5 RSV Neutralization Assays

In this example the IgG form of 58c5, generated in Example 7 above, and motavizumab were tested for their ability to neutralize various strains of RSV. Additionally, the IgG form of 58c5 was analyzed for its ability to neutralize various monoclonal antibody resistant RSV escape mutants (MARMs). A MARM is a mutant RSV strain that is no longer capable of being neutralized by the antibody that it was generated against. Therefore, the ability of the IgG form of 58c5 to neutralize a specific MARM indicates that the binding epitope of 58c5 is different from that of the antibody to which the MARM was generated.

A. Neutralization of RSV

The IgG form of 58c5 and motavizumab were tested for their ability to neutralize RSV (as described in Example 6 above). The data is shown in Tables 19-21 below. Table 20 lists the ED50 (effective dilution for 50% neutralization) for each RSV strain. Table 21 lists the plaque counts for the various RSV strains and at the varying antibody concentrations. Table 22 lists the plaque reduction rate for the various RSV strains and at varying antibody concentrations. The results indicate the IgG form of 58c5 is capable of neutralizing all 3 strains of RSV. Based on the data obtained in the neutralization assay and the molecular weight of the IgG form of 58c5 fragment (approximately 150 kDa), the $EC_{50}$ of the IgG form of 58c5 for in vitro neutralization of RSV was estimated to be approximately 133 pM. Motavizumab has a corresponding $EC_{50}$ of 360 pM.

TABLE 20

| IgG Neutralization Data ($ED_{50}$) | | | |
|---|---|---|---|
| Antigen | RSV A2 | RSV B-1 | RSV B/wash |
| IgG form of 58c5 | 133 pM (0.02 μg/mL) | 280 pM (0.042 μg/mL) | 193 pM (0.029 μg/mL) |
| Motavizumab | 360 pM | 833 pM | 2.9 nM |

TABLE 21

| Average Plaque Count for Neutralization with IgG form of 58c5 | | | | | | | |
|---|---|---|---|---|---|---|---|
| Antigen | 10 ug/ml | 2 ug/ml | 0.4 ug/ml | 0.08 ug/ml | 0.016 ug/ml | 0.003 ug/ml | 0 ug/ml |
| RSV A2 | 0.3 | 0 | 0.7 | 16.3 | 31 | 40.3 | 57.7 |
| RSV B/wash | 0 | 0 | 1.3 | 7.7 | 16.3 | 20.7 | 26.3 |
| RSV B-1 | 0 | 0 | 0.3 | 4 | 9.3 | 11.7 | 12.3 |

TABLE 22

| Plaque reduction rate (%) for Neutralization with IgG form of 58c5 | | | | | | | |
|---|---|---|---|---|---|---|---|
| Antigen | 10 ug/ml | 2 ug/ml | 0.4 ug/ml | 0.08 ug/ml | 0.016 ug/ml | 0.003 ug/ml | 0 ug/ml |
| RSV A2 | 99.5 | 100 | 99 | 72 | 46 | 30 | 0 |
| RSV B/wash | 100 | 100 | 95 | 71 | 38 | 21 | 0 |
| RSV B-1 | 100 | 100 | 97.6 | 67.5 | 24 | 5 | 0 |

B. Neutralization of RSV Monoclonal Antibody Resistant RSV Escape Mutants

The IgG form of 58c5 was also tested for its ability to neutralize several monoclonal antibody resistant RSV escape mutants (provided by Dr. James Crowe, Vanderbilt University), as described in Example 6 above. The MARMS, listed in Table 23 below, were derived from RSV wild-type strain A2. MARM 19, generated against human Fab 19 (see, e.g., Crowe et al., Virology, 252:373-375 (1998)), contains the amino acid mutation isoleucine 266 to methionine. MARM 151, generated against murine mAb 151, contains the amino acid mutation lysine 272 to asparagine. MARM 1129, generated against the murine mAb 1129 which is the parental antibody to palivizumab (SYNAGIS), contains the amino acid mutation serine 275 to phenylalanine.

The IgG form of 58c5 was also tested for its ability to neutralize several RSV Monoclonal Antibody Resistant Mutants (MARMs). The data is shown in Tables 23-24 below. Table 23 lists the plaque counts for neutralization against the various MARMs at varying antibody concentrations. Table 24 lists the plaque reduction rate for neutralization against the various MARMs at varying antibody concentrations. The results indicate IgG 58c5 is capable of neutralizing all 3 RSV MARMS. Thus, the 58c5 binds a different epitope of RSV strain A2 than Fab 19, murine mAb 1129 and murine mAb 151.

TABLE 23

| Average Plaque Count for Neutralization of IgG form of 58c5 versus RSV MARMS | | | | | | | |
|---|---|---|---|---|---|---|---|
| MARM | 10 ug/ml | 2 ug/ml | 0.4 ug/ml | 0.08 ug/ml | 0.016 ug/ml | 0.003 ug/ml | 0 ug/ml |
| MARM 19 | 0.7 | 16.7 | 72 | 89.3 | 135 | 143 | 156 |
| MARM 151 | 0 | 15.3 | 64.7 | 112 | 128 | 151 | 151 |
| MARM 1129 | 0 | 0 | 2.3 | 5.7 | 11.7 | 17.7 | 22.3 |

TABLE 24

| Plaque reduction rate for Neutralization of IgG form of 58c5 versus RSV MARMS | | | | | | | |
|---|---|---|---|---|---|---|---|
| MARM | 10 ug/ml | 2 ug/ml | 0.4 ug/ml | 0.08 ug/ml | 0.016 ug/ml | 0.003 ug/ml | 0 ug/ml |
| MARM 19 | 100 | 89 | 53.8 | 42.7 | 14 | 8 | 0 |
| MARM 151 | 100 | 90 | 57 | 26 | 15 | 0 | 0 |
| MARM 1129 | 100 | 100 | 90 | 74 | 47 | 21 | 0 |

Example 10

Competition Assays

In this example, competition assays were performed in which Motavizumab IgG (Wu et al. (2007) *J. Mol. Biol.* 368(3):652-665) was tested for its ability to compete against Fab 58c5 for binding to RSV F protein. As a positive control for competition, the IgG form of 58c5 was competed against 58c5 Fab.

Briefly, ELISA plates were prepared as described in Example 1 above, with either recombinant or native RSV strain A2 F protein. The plates were blocked with 4% nonfat dry milk in 1×PBS for 2 hours at 37° C. followed by washing 4× with wash buffer (PBS/0.05% Tween20). Fab 58c5 was titrated in PBS/3% BSA/0.01% Tween20 from 9 μg/mL to 0.0001 μg/mL (actual concentrations tested: 9, 3, 1, 0.3, 0.1, 0.03, 0.01, 0.003, 0.001, 0.0003, 0.0001 μg/mL). The IgG form of 58c5 and Motavizumab were added at fixed concentrations of either 0.5 μg/mL, 0.1 μg/mL, 0.05 μg/mL and 0.01 μg/mL (as indicated in Table 25 below). 50 μL each of diluted Fab and fixed concentration IgG was added simultaneously to each well of a plate, in duplicate, as indicated in Table 26 below, and the plates were incubated at 37° C. for 2 hours followed by washing 4× with wash buffer. Goat anti-human IgG Fc-gamma HRP (Jackson ImmunoResearch, Cat. No. 109-035-098, diluted 1:1000, was added and the plates were incubated at 37° C. for 1 hour. Following washing 6× with wash buffer, 50 μL 1:1 v/v TMB:peroxide solution (Pierce, Cat No. 34021) was added and allowed to develop for 7 minutes. The reaction was immediately halted by the addition of 50 μL 2N $H_2SO_4$ and the absorbance at 450 nm was measured using an ELISA plate reader.

TABLE 25

| Competition Assays | | |
|---|---|---|
| | Antigen | |
| Fab 58c5 | Recombinant F protein | Native F protein |
| 9 to 0.0001 μg/mL | 0.05 μg/mL IgG form of 58c5 | 0.05 μg/mL IgG form of 58c5 |
| | 0.1 μg/mL motavizumab IgG | 0.01 μg/mL motavizumab IgG |

The results are summarized in Table 26 below. Motavizumab does not compete against Fab 58C5 for binding to either native or recombinant RSV strain A2 F protein.

TABLE 26

| Summary of Competition Assays | | |
|---|---|---|
| | Motavizumab IgG | IgG form of 58c5 |
| 58C5 Fab | NO | YES |

Example 11

RSV MARM Generation and Neutralization Assays

In this example, monoclonal antibody resistant RSV escape mutants (MARMs) were generated for Motavizumab and the IgG form of 58C5. Motavizumab and the IgG form of 58C5 were further analyzed for their ability to neutralize the newly generated MARMs.

A. MARM Generation

1. Motavizumab

The concentration of motavizumab IgG that reduces RSV viral titers by 3 logs (corresponding to 99.9% inhibition of RSV A2 virus by neutralization assay) was previously determined to be 3.2 μg/mL. RSV A2 viral particles ($2\times10^6$) were preincubated with dilutions of motavizumab IgG and this mixture was used to infect Vero cell monolayers (as described in Example 6 above). Wells with the highest antibody concentrations still demonstrating cytotoxic effects were selected for additional rounds of selection. After 10 rounds of selection, plaques from virus grown in the presence of 8 μg/mL motavizumab were obtained. Virus particles from these plaques were tested in neutralization assays (as described in Example 6 above) and RNA from positive particles was prepared using a RNeasy extraction kit (Qiagen). Six escape mutants were selected and the F gene was amplified by PCR. The DNA was sequenced and all six clones encoded a single amino acid substitution of glutamic acid for lysine at position 272 (K272E, SEQ ID NO:1642) compared to the parental RSV A2 strain (set forth in SEQ ID NO:1629).

Table 27 below sets forth the highest antibody concentration demonstrating cytopathic effects (CPE) for each round of selection. As shown in Table 27 below, motavizumab escape mutants were identified after 7 rounds of selection, as identified by an antibody concentration demonstrating CPE greater than the concentration of motavizumab that corresponds to 99.9% inhibition of RSV A2 virus as determined by neutralization assay (i.e., >3.2 μg/mL).

TABLE 27

| Motavizumab MARM Selection | |
|---|---|
| Selection Round | Antibody Concentration (μg/mL) |
| 1 | 0.5 |
| 2 | 0.5 |
| 3 | 0.75 |
| 4 | 1 |
| 5 | 2 |
| 6 | 3 |
| 7 | 4 |
| 8 | 8 |
| 9 | 8 |
| 10 | 8 |

2. The IgG Form of 58C5

The concentration of the IgG form of 58C5 that reduces RSV viral titers by 3 logs (corresponding to 99.9% inhibition of RSV A2 virus by neutralization assay) was determined to be 0.8 μg/mL. RSV A2 viral particles ($2\times10^6$) were preincubated with dilutions of 58C5 IgG and this mixture was used to infect Vero cell monolayers (as described in Example 6 above). Wells with the highest antibody concentrations still demonstrating cytotoxic effects were selected for additional rounds of selection. After 12 rounds of selection, plaques from virus grown in the presence of 2 μg/mL of the IgG form of 58C5 were obtained. Virus particles from these plaques were tested in neutralization assays (as described in Example 6 above) and RNA from positive particles was prepared using a RNeasy extraction kit (Qiagen). Five escape mutants were selected and the F gene was amplified by PCR. The DNA was sequenced and all five clones encoded three amino acid substitutions (N63K, M115K and E295G; SEQ ID NO:1643) compared to the parental RSV A2 strain (set forth in SEQ ID NO:1629).

Table 28 below sets forth the highest antibody concentration demonstrating cytopathic effects (CPE) for each round of selection. As shown in Table 28 below, the IgG form of 58C5 escape mutants were identified after 10 rounds of selection, as identified by an antibody concentration demonstrating CPE greater than the concentration of the IgG form of 58C5 that corresponds to 99.9% inhibition of RSV A2 virus as determined by neutralization assay (i.e., >0.8 μg/mL).

TABLE 28

| IgG form of 58C5 MARM Selection | |
|---|---|
| Selection Round | Antibody Concentration (μg/mL) |
| 1 | 0.2 |
| 2 | 0.2 |
| 3 | 0.3 |
| 4 | 0.4 |
| 5 | 0.6 |
| 6 | 0.6 |
| 7 | 0.6 |
| 8 | 0.6 |
| 9 | 0.6 |
| 10 | 1.2 |
| 11 | 1.6 |
| 12 | 2 |

B. Neutralization Assays

Motavizumab and the IgG form of 58C5 were tested for their ability to neutralize the RSV A2 parental virus strain, the motavizumab MARM and the IgG form of 58C5 MARM. The neutralization assay procedures is described in Example 6 above. The data is shown in Tables 29-32 below. Table 29 lists the plaque reduction rate for neutralization against the RSV A2 parental virus. Table 30 lists the plaque reduction rate for neutralization against the Motavizumab MARM. Table 31 lists the plaque reduction rate for neutralization against the IgG form of 58C5 MARM. Table 32 is a summary of the neutralization data (ED50 values).

The results indicate that both antibodies are capable of neutralizing the parental RSV A2 strain, with IgG 58C5 showing the strongest activity (see Table 29). The IgG form of 58C5 strongly neutralizes the motavizumab MARM with no difference compared to the parental strain (see Table 30). As expected, motavizumab cannot neutralize the motavizumab MARM at any of the tested concentrations. Motavizumab strongly neutralizes the IgG form of 58C5 MARM with no difference in neutralization potency (see Table 31). As expected, the IgG form of 58C5 cannot neutralize the IgG form of 58C5 MARM at any of the tested concentrations. The results show that both the IgG form of 58C5 neutralizes the motavizumab MARM indicating no competition.

TABLE 29

Plaque reduction rate for Neutralization of RSV A2 parental virus

| Antibody | 10000 ng/ml | 2000 ng/ml | 400 ng/ml | 80 ng/ml | 16 ng/ml | 3.2 ng/ml |
|---|---|---|---|---|---|---|
| Motavizumab | 100.0 | 98.87 | 82.27 | 50.40 | 19.25 | 0.40 |
| IgG form of 58C5 | 100.0 | 100.0 | 99.6 | 87.0 | 49.2 | 6.1 |

TABLE 30

Plaque reduction rate for Neutralization of Motavizumab MARM

| Antibody | 10000 ng/ml | 2000 ng/ml | 400 ng/ml | 80 ng/ml | 16 ng/ml | 3.2 ng/ml |
|---|---|---|---|---|---|---|
| Motavizumab | 13.3 | 1.7 | 0.0 | 0.2 | 3.3 | 0.0 |
| IgG 58C5 | 97.6 | 95.8 | 92.0 | 74.6 | 43.0 | 1.5 |

TABLE 31

Plaque reduction rate for Neutralization of IgG 58C5 MARM

| Antibody | 10000 ng/ml | 2000 ng/ml | 400 ng/ml | 80 ng/ml | 16 ng/ml | 3.2 ng/ml |
|---|---|---|---|---|---|---|
| Motavizumab | 94.8 | 92.9 | 83.9 | 47.1 | 6.5 | 0.0 |
| IgG 58C5 | 3.3 | 0.0 | 0.0 | 0.0 | 0.0 | 0.0 |

TABLE 32

Summary of Neutralization (ED50) values

| | RSV A2 Parental (ED50) | Motavizumab MARM (ED50) | IgG 58C5 MARM (ED50) |
|---|---|---|---|
| Motavizumab | 519 pM | >66.7 nM | 641 pM |
| IgG 58C5 | 115 pM | 173 pM | >66.7 nM |

Since modifications will be apparent to those of skill in this art, it is intended that this invention be limited only by the scope of the appended claims.

SEQUENCE LISTING (1643 sequences)

SEQ ID NO: 1 - protein, 228 aa, Homo sapiens
  58c5 Heavy Chain
QVQLVQSGPGLVKPSQTLALTCNVSGASINSDNYYWTWIRQRPGGGLEWIGHISYTGNTYYTPSLKSRLSMSLETSQSQFSLRLTSVTAADSAVYFCAACGAYVLISNCGWFDSWGQGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 2 - protein, 12 aa, Homo sapiens
  58c5 VH CDR1
GASINSDNYYWT

SEQ ID NO: 3 - protein, 16 aa, Homo sapiens
  58c5 VH CDR2
HISYTGNTYYTPSLKS

SEQ ID NO: 4 - protein, 15 aa, Homo sapiens
  58c5 VH CDR3
CGAYVLISNCGWFDS

SEQ ID NO: 5 - protein, 214 aa, Homo sapiens
  58c5 Light Chain
EIVMTQSPSSLSASIGDRVTITCQASQDISTYLNWYQQKPGQAPRLLIYGASNLETGVPSRFTGSGYGTDFSVTISSLQPEDIATYYCQQYQYLPYTFAPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6 - protein, 11 aa, Homo sapiens
  58c5 VL CDR1
QASQDISTYLN

SEQ ID NO: 7 - protein, 7 aa, Homo sapiens
  58c5 VL CDR2
GASNLET

SEQ ID NO: 8 - protein, 9 aa, Homo sapiens
  58c5 VL CDR3
QQYQYLPYT

SEQ ID NO: 9 - protein, 228 aa, Homo sapiens
  sc5 Heavy Chain
QVQLQESGPGLVKPSGTLSLTCTVSGDSISGSNWWNWVRQPPGKGLEWIGEIYYRGTTNYKSSLKGRVTMSVDTSKNQFSLKLTSVTAADTAVYYCARGGRSTFGPDYYYYMDVWGRGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10 - protein, 11 aa, Homo sapiens
  sc5 VH CDR1
GDSISGSNWWN

SEQ ID NO: 11 - protein, 16 aa, Homo sapiens
  sc5 VH CDR2
EIYYRGTTNYKSSLKG

SEQ ID NO: 12 - protein, 16 aa, Homo sapiens
  sc5 VH CDR3
GGRSTFGPDYYYYMDV

SEQ ID NO: 13 - protein, 214 aa, Homo sapiens
  sc5 Light Chain
DIQMTQSPSSLSASVGDRVTITCRASQNIKNYLNWYQQKPGKVPKLLIYAASTLQSGVPSRFSGSGSGTDFTLTISSLQPEDFATYSCQQSYNNQLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14 - protein, 11 aa, Homo sapiens
  sc5 VL CDR1
RASQNIKNYLN

SEQ ID NO: 15 - protein, 7 aa, Homo sapiens
  sc5 VL CDR2
AASTLQS

SEQ ID NO: 16 - protein, 9 aa, Homo sapiens
  sc5 VL CDR3
QQSYNNQLT

SEQ ID NO: 17 - DNA, 702 bp, Homo sapiens
  58c5 Heavy Chain
caggtccagcttgtgcagtcgggcccaggactggtgaagccttcacagaccctggccctcacctgcaatgtctctggtgcctccatcaatagtgataattactactggacgtggatccgtcagcgcccaggggggggcctggagtggattggccacatctcttacactgggaacacctactacaccccgtcactcaagagccgactttccatgtcactagagacatctcagagccaattctccctgaggctgacctctgtgactgccgcggactcggccgtctatttctgtgcggcctgcggggcatatgttttaatatcaaactgtggctggttcgactcctggggccagggaacccaggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtggtcggccaggccggccg

SEQ ID NO: 18 - DNA, 645 bp, Homo sapiens
  58c5 Light Chain
gaaatagtgatgacgcagtctccatcctccctgtctgcatctataggagacagagtcaccatcacttgccaggcgagtcaggacattagcacctatttaaattggtatcagcagaaaccagggcaagcccctaggctcctgatctacggagcgtccaatttggagacaggggtcccatcaaggttcactggaagtggatatgggacagacttctctgtcaccatcagcagcctgcagcctgaagatattgcaacatattactgtcaacagtaccaatatctcccgtacacttttgccccggggaccaaggtcgagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgctaa

SEQ ID NO: 19 - DNA, 687 bp, Homo sapiens
  sc5 Heavy Chain
caggtgcagctgcaggagtcgggcccaggactggtgaagccttcggggaccctgtccctcacttgcactgtctctggtgactccatcagcggctctaactggtggaattgggtccgccagcccccagggaaggggctggagtggattggggaaatctattatcgtgggactaccaattataagtcgtccctcaagggtcgagtcaccatgtcagttgacacgtccaagaaccagttctccctgaagctgacctctgtgaccgccgcggacacggccgtatattattgtgcgagaggggggaggtccacctttggtccggactactactactacatggacgtctggggcagagggaccacggtcaccgtctcctcagcgtcgaccaaaggtccgtctgttttcccgctggctccgtcttctaaatctacctctggtggtaccgctgctctgggttgcctggttaaagactacttcccggaaccggttaccgtttcttggaactctggtgctctgacctctggtgttcacaccttcccggctgttctgcagtcttctggtctgtactctctgtcttctgttgttaccgttccgtcttcttctctgggtacccagacctacatctgcaacgttaaccacaaaccgtctaacaccaaagttgacaagaaagttgaaccgaaatcttgcctg

SEQ ID NO: 20 - DNA, 642 bp, Homo sapiens
  sc5 Light Chain
gacatccagatgacccagtctccatcctccctgtctgcctctgtaggtgacagagtcaccatcacttgccgggcaagtcagaacattaagaactatttaaattggtatcaacaaaaaccagggaaagtcccgaagctcctgatctatgctgcatccactttgcagagtggggtcccatcgaggttcagtggcagtggatctgggacagacttcactctcaccatcagcagtctgcaacctgaagattttgcaacttactcctgtcaacagagttacaataaccagctcactttcggcggtgggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgc

SEQ ID NO: 21 - DNA, 1665 bp, Artificial Sequence
  RSV A2 F protein
gctagcggtaccatgggcgagctcctcatcctgaaggccaacgccatcaccaccatcctgaccgctgtgaccttctgcttcgccagcggccagaacatcaccgaggaattctaccagagcacctgcagcgccgtgagcaagggctacctgagcgccctgcggaccggctggtacaccagcgtgatcaccatcgagctgtccaacatcaaagaaaacaagtgcaacggcaccgacgccaaagtgaagctgatcaagcaggaactggacaagtacaagaacgccgtgaccgagctgcagctgctgatgcagagcaccccccccaccaacaaccgggccagaagagaactgccccggttcatgaactacaccctgaacaacgccaagaaaaccaacgtgaccctgagcaagaagcggaagcggcggttcctgggcttcctgctgggcgtgggcagcgccattgccagcggcgtggccgtgtccaaagtgctgcacctggaaggcgaagtgaacaagatcaagtccgccctgctgtccaccaacaaggccgtggtgtccctgagcaacggcgtgagcgtgctgaccagcaaggtgctggatctgaagaactacatcgacaagcagctgctgcccatcgtgaacaagcagagctgcagcatcagcaacatcgagacagtgatcgagttccagcagaagaacaaccggctgctggaaatcacccgggagttcagcgtgaacgctggcgtgaccacccccgtgtccacctacatgctgaccaactccgagctgctctccctgatcaatgacatgcccatcaccaacgaccagaaaaagctgatgagcaacaacgtgcagatcgtgcggcagcagagctactccatcatgagcatcatcaaagaagaggtgctggcctacgtggtgcagctgcccctgtacggcgtgatcgacaccccctgctggaagctgcacaccagccccctgtgcaccaccaacaccaaagagggcagcaacatctgcctgacccggaccgaccggggctggtactgcgacaacgccggcagcgtgtcattcttcccacaagccgagacatgcaaggtgcagagcaaccgggtgttctgcgacaccatgaacagcctgaccctgcccagcgagatcaacctgtgcaacgtggacatcttcaaccccaagtacgactgcaagatcatgacctccaagaccgacgtgtccagctccgtgatcacctccctgggcgccatcgtgtcctgctacggcaagaccaagtgcaccgccagcaacaagaaccggggcatcatcaagaccttcagcaacggctgcgactacgtgtccaacaagggcatggacaccgtgtccgtgggcaacacactgtactacgtgaataagcaggaaggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaatgtgaatgccggcaagtccaccaccaaccaagcttacgtagaacaaaaactcatctcagaagaggatctgaatagcgccgtcgaccatcatcatcatcatcattga

SEQ ID NO: 22 - DNA, 6 bp, Artificial Sequence
  NheI Restriction Site
gctagc

SEQ ID NO: 23 - DNA, 6 bp, Artificial Sequence
  HindIII Restriction Site
aagctt

SEQ ID NO: 24 - DNA, 5521 bp, Artificial Sequence
  pcDNA 3.1/myc-His(-) C vector
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacgggccctctagactcgagcggccgccactgtgctggatatctgcagaattccaccacactggactagtggatccgagctcggtaccaagcttacgtagaacaaaaactcatctcagaagaggatctgaatagcgccgtcgaccatcatcatcatcatcattgagtttaaacggtctccagcttaagtttaaaccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 25 - protein, 550 aa, Artificial Sequence
  RSV A2 F protein
MGELLILKANAITTILTAVTFCFASGQNITEEFYQSTCSAVSKGYLSALRTGWYTSVITIELSNIKENKCNGTDAKVKLIKQELDKYKNAVTELQLLMQSTPPTNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEINLCNVDIFNPKYDCKIMTSKTDVSSSVITSLGAIVSCYGKTKCTASNKNRGIIKTFSNGCDYVSNKGMDTVSVGNTLYYVNKQEGKSLYVKGEPIINFYDPLVFPSDEFDASISQVNEKINQSLAFIRKSDELLHNVNAGKSTTNQAYVEQKLISEEDLNSAVDHHHHHH

SEQ ID NO: 26 - DNA, 24 bp, Artificial Sequence
  VH1a Forward Primer
ggatcctcttcttggtggcagcag

SEQ ID NO: 27 - DNA, 24 bp, Artificial Sequence
  VH1b Forward Primer
gcatccttttcttggtggcagcac

SEQ ID NO: 28 - DNA, 24 bp, Artificial Sequence
  VH1c Forward Primer
gggtcttctgcttgctggctgtag

SEQ ID NO: 29 - DNA, 24 bp, Artificial Sequence
  VH1d Forward Primer
ggatcctcttcttggtgggagcag

SEQ ID NO: 30 - DNA, 24 bp, Artificial Sequence
  VH2a Forward Primer
ctgaccatcccttcatggctcttg

SEQ ID NO: 31 - DNA, 24 bp, Artificial Sequence
  VH2b Forward Primer
ctgaccaccccttcctgggtcttg

SEQ ID NO: 32 - DNA, 24 bp, Artificial Sequence
  VH3a Forward Primer
gctattttaraaggtgtccagtgt

SEQ ID NO: 33 - DNA, 24 bp, Artificial Sequence
  VH3b Forward Primer
gctcttttaagaggtgtccagtgt

SEQ ID NO: 34 - DNA, 24 bp, Artificial Sequence
  VH3c Forward Primer
gctatttaaaaaggtgtccaatgt

SEQ ID NO: 35 - DNA, 24 bp, Artificial Sequence
  VH4a Forward Primer
ctggtggcagctcccagatgggtc

SEQ ID NO: 36 - DNA, 24 bp, Artificial Sequence
  VH5a Forward Primer
ctcctggctgttctccaaggagtc

SEQ ID NO: 37 - DNA, 28 bp, Artificial Sequence
  VH-g 1-REV Reverse Primer
acaagatttgggctcaactttcttgtcc

SEQ ID NO: 38 - DNA, 28 bp, Artificial Sequence
  VH-g 2-REV Reverse Primer
tttgcgctcaactgtcttgtccaccttg

SEQ ID NO: 39 - DNA, 28 bp, Artificial Sequence
  VH-g 3-REV Reverse Primer
tttgagctcaactctcttgtccaccttg

SEQ ID NO: 40 - DNA, 28 bp, Artificial Sequence
  VH-g 4-REV Reverse Primer
atatttggactcaactctcttgtccacc

SEQ ID NO: 41 - DNA, 13 bp, Artificial Sequence
  SfiI Restriction Site
  misc_feature (5)...(9): N = a or g or c or t
ggccnnnnnggcc

SEQ ID NO: 42 - DNA, 48 bp, Artificial Sequence
  pCal30 VH1a Forward Primer
ggctttgctaccgtagcgcaggcggccgcacaggtkcagctggtgcag

SEQ ID NO: 43 - DNA, 48 bp, Artificial Sequence
  pCal30 VH1b Forward Primer
ggctttgctaccgtagcgcaggcggccgcacaggtccagcttgtgcag

SEQ ID NO: 44 - DNA, 48 bp, Artificial Sequence
  pCal30 VH1c Forward Primer
ggctttgctaccgtagcgcaggcggccgcasaggtccagctggtacag

SEQ ID NO: 45 - DNA, 48 bp, Artificial Sequence
  pCal30 VH1d Forward Primer
ggctttgctaccgtagcgcaggcggccgcacaratgcagctggtgcag

SEQ ID NO: 46 - DNA, 48 bp, Artificial Sequence
  pCal30 VH2a Forward Primer
ggctttgctaccgtagcgcaggcggccgcacagatcaccttgaaggag

SEQ ID NO: 47 - DNA, 48 bp, Artificial Sequence
  pCal30 VH3a Forward Primer
ggctttgctaccgtagcgcaggcggccgcagargtgcagctggtggag

SEQ ID NO: 48 - DNA, 48 bp, Artificial Sequence
  pCal30 VH4a Forward Primer
ggctttgctaccgtagcgcaggcggccgcacagstgcagctgcaggag

SEQ ID NO: 49 - DNA, 48 bp, Artificial Sequence
  pCal30 VH4b Forward Primer
ggctttgctaccgtagcgcaggcggccgcacaggtgcagctacagcag

SEQ ID NO: 50 - DNA, 48 bp, Artificial Sequence
  pCal30 VH5a Forward Primer
ggctttgctaccgtagcgcaggcggccgcagargtgcagctggtgcag

SEQ ID NO: 51 - DNA, 48 bp, Artificial Sequence
  pCal30 VH6 Forward Primer
ggctttgctaccgtagcgcaggcggccgcacaggtacagctgcagcag

SEQ ID NO: 52 - DNA, 48 bp, Artificial Sequence
  pCal30 VH7 Forward Primer
ggctttgctaccgtagcgcaggcggccgcacaggtscagctggtgcaa

SEQ ID NO: 53 - DNA, 42 bp, Artificial Sequence
  VHII-g1-Rev Reverse Primer
tgcggccggcctggccgaccacaagatttgggctcaactttc

SEQ ID NO: 54 - DNA, 42 bp, Artificial Sequence
  VHII-g2-Rev Reverse Primer
tgcggccggcctggccgacctttgcgctcaactgtcttgtcc

SEQ ID NO: 55 - DNA, 42 bp, Artificial Sequence
  VHII-g3-Rev Reverse Primer
tgcggccggcctggccgacctttgagctcaactctcttgtcc

SEQ ID NO: 56 - DNA, 42 bp, Artificial Sequence
  VHII-g4-Rev Reverse Primer
tgcggccggcctggccgaccatatttggactcaactctcttg

SEQ ID NO: 57 - DNA, 45 bp, Artificial Sequence
  VK 1a Forward Primer
aaggcccagccggccatggccgccggtgacatccagatgacccag

SEQ ID NO: 58 - DNA, 45 bp, Artificial Sequence
  VK 1b Forward Primer
aaggcccagccggccatggccgccggtgacatccagttgacccag

SEQ ID NO: 59 - DNA, 45 bp, Artificial Sequence
  VK 1c Forward Primer
aaggcccagccggccatggccgccggtgccatccggttgacccag

SEQ ID NO: 60 - DNA, 45 bp, Artificial Sequence
  VK 2a Forward Primer
aaggcccagccggccatggccgccggtgatattgtgatgacycag

SEQ ID NO: 61 - DNA, 45 bp, Artificial Sequence
  VK 3a Forward Primer
aaggcccagccggccatggccgccggtgaaattgtgttgacgcag

SEQ ID NO: 62 - DNA, 45 bp, Artificial Sequence
  VK 3b Forward Primer
aaggcccagccggccatggccgccggtgaaattgtgttgacacag

SEQ ID NO: 63 - DNA, 45 bp, Artificial Sequence
  VK 4a Forward Primer
aaggcccagccggccatggccgccggtgaaatagtgatgacgcag

SEQ ID NO: 64 - DNA, 45 bp, Artificial Sequence
  VK 4a  Forward Primer
aaggcccagccggccatggccgccggtgacatcgtgatgacccag

SEQ ID NO: 65 - DNA, 45 bp, Artificial Sequence
  VK 5a  Forward Primer
aaggcccagccggccatggccgccggtgaaacgacactcacgcag

SEQ ID NO: 66 - DNA, 45 bp, Artificial Sequence
  VK 6a  Forward Primer
aaggcccagccggccatggccgccggtgaaattgtgctgactcag

SEQ ID NO: 67 - DNA, 45 bp, Artificial Sequence
  VK 6b  Forward Primer
aaggcccagccggccatggccgccggtgatgttgtgatgacacag

SEQ ID NO: 68 - DNA, 44 bp, Artificial Sequence
  pCALCK(G)L Reverse Primer
ctccttattaattaattagcactctcccctgttgaagctctttg

SEQ ID NO: 69 - DNA, 50 bp, Artificial Sequence
  VL1-F Forward Primer
aaggcccagccggccatggccgccggtgttcagtctgtgctgackcagcc

SEQ ID NO: 70 - DNA, 50 bp, Artificial Sequence
  VL2-F Forward Primer
aaggcccagccggccatggccgccggtgttcagtctgccctgactcagcc

SEQ ID NO: 71 - DNA, 50 bp, Artificial Sequence
  VL3A-F Forward Primer
aaggcccagccggccatggccgccggtgtttcctatgagctgacwcagcy

SEQ ID NO: 72 - DNA, 51 bp, Artificial Sequence
  VL3B-F Forward Primer
aaggcccagccggccatggccgccggtgtttcttctgagctgactcaggac

SEQ ID NO: 73 - DNA, 50 bp, Artificial Sequence
  VL3C-F Forward Primer
aaggcccagccggccatggccgccggtgtttcctatgwgctgactcagcc

SEQ ID NO: 74 - DNA, 51 bp, Artificial Sequence
  VL4A-F Forward Primer
aaggcccagccggccatggccgccggtgttctgcctgtgctgactcagccc

SEQ ID NO: 75 - DNA, 51 bp, Artificial Sequence
  VL4B-F Forward Primer
aaggcccagccggccatggccgccggtgttcagcytgtgctgactcaatcr

SEQ ID NO: 76 - DNA, 51 bp, Artificial Sequence
  VL5/9-F Forward Primer
aaggcccagccggccatggccgccggtgttcagsctgtgctgactcagccr

SEQ ID NO: 77 - DNA, 51 bp, Artificial Sequence
  VL6-F Forward Primer
aaggcccagccggccatggccgccggtgttaattttatgctgactcagccc

SEQ ID NO: 78 - DNA, 51 bp, Artificial Sequence
  VL7/8-F Forward Primer
aaggcccagccggccatggccgccggtgttcagrctgtggtgactcaggag

SEQ ID NO: 79 - DNA, 51 bp, Artificial Sequence
  VL10-F Forward Primer
aaggcccagccggccatggccgccggtgttcaggcagggctgactcagcca

SEQ ID NO: 80 - DNA, 43 bp, Artificial Sequence
  pCALCL(T)-R Reverse Primer
ctccttattaattaattatgagcattctgyakgggcmaytgtc

SEQ ID NO: 81 - DNA, 4765 bp, Artificial Sequence
  2g12/pCal Vector
gtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaattgaattaaggaggatataattatgaaatacctgctgccgaccgcagccgctggtctgctgctgctcgcggcccagccggccatggccgccggtgttgttatgacccagtctccgtctaccctgtctgcttctgttggtgacaccatcaccatcacctgccgtgcttctcagtctatcgaaacctggctggcttggtaccagcagaaaccgggtaaagctccgaaactgctgatctacaaggcttctaccctgaaaaccggtgttccgtctcgtttctctggttctggttctggtaccgagttcaccctgaccatctctggtctgcagttcgacgacttcgctacctaccactgccagcactacgctggttactctgctaccttcggtcagggtacccgtgttgaaatcaaacgtaccgttgctgctccgtctgttttcatcttcccgccgtctgacgaacagctgaaatctggtaccgcttctgttgtttgcctgctgaacaacttctacccgcgtgaagctaaagttcagtggaaagttgacaacgctctgcagtctggtaactctcaggaatctgttaccgaacaggactctaaagactctacctactctctgtcttctaccctgaccctgtctaaagctgactacgaaaagcacaaagtttacgcttgcgaagttacccaccagggtctgtcttctccggttaccaaatctttcaaccgtggtgaatgctaattaattaataaggaggatataattatgaaaaagacagctatcgcgattgcagtggcactggctggtttcgctaccgtagcccaggcggccgcagaagttcagctggttgaatctggtggtggtctggttaaagctggtggttctctgatcctgtcttgcggtgtttctaacttccgtatctctgctcacaccatgaactgggttcgtcgtgttccgggtggtggtctggaatgggttgcttctatctctacctcttctacctaccgtgactacgctgacgctgttaaaggtcgtttcaccgtttctcgtgacgacctggaagacttcgtttacctgcagatgcataaaatgcgtgttgaagacaccgctatctactactgcgctcgtaaaggttctgaccgtctgtctgacaacgacccgttcgacgcttggggtccgggtaccgttgttaccgtttctccggcgtcgaccaaaggtccgtctgttttcccgctggctccgtcttctaaatctacctctggtggtaccgctgctctgggttgcctggttaaagactacttcccggaaccggttaccgtttcttggaactctggtgctctgacctctggtgttcacaccttcccggctgttctgcagtcttctggtctgtactctctgtcttctgttgttaccgttccgtcttcttctctgggtacccagacctacatctgcaacgttaaccacaaaccgtctaacaccaaagttgacaagaaagttgaaccgaaatcttgcctgcgatcgcggccaggccggccgcaccatcaccatcaccatggcgcatacccgtacgacgttccggactacgcttctactagttagaagggtggtggctctgagggtggcggttctgagggtggcggctctgagggaggcggttccggtggtggctctggttccggtgattttgattatgaaaagatggcaaacgctaataagggggctatgaccgaaaatgccgatgaaaacgcgctacagtctgacgctaaaggcaaacttgattctgtcgctactgattacggtgctgctatcgatggtttcattggtgacgtttccggccttgctaatggtaatggtgctactggtgattttgctggctctaattcccaaatggctcaagtcggtgacggtgataattcacctttaatgaataatttccgtcaatatttaccttccctccctcaatcggttgaatgtcgcccttttgtctttggcgctggtaaaccatatgaattttctattgattgtgacaaaataaacttattccgtggtgtctttgcgtttcttttatatgttgccacctttatgtatgtattttctacgtttgctaacatactgcgtaataaggagtcttaagctagctaacgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttag

SEQ ID NO: 82 - DNA, 40 bp, Artificial Sequence
  FabLinkerCK-Fwd
gagcttcaacaggggagagtgctaattaattaataaggag

SEQ ID NO: 83 - DNA, 42 bp, Artificial Sequence
  FabLinker-Rev
tgcggccgcctgcgctacggtagcaaagccagccagtgccac

SEQ ID NO: 84 - DNA, 22 bp, Artificial Sequence
  Sfi Forward Primer
tcgcggcccagccggccatggc

SEQ ID NO: 85 - DNA, 18 bp, Artificial Sequence
  Sfi Reverse Primer
tgcggccggcctggccga

SEQ ID NO: 86 - DNA, 4779 bp, Artificial Sequence
  4E10 pCAL vector
gtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaattgaattaaggaggatataattatgaaatacctgctgccgaccgcagccgctggtctgctgctgctcgcggcccagccggccatggccgccggtgaaattgtcttgacgcaaagcccggggacccagtcgctgtccccgggagagcgcgcgaccctgtcatgtcgtgcgagtcaaagtgtcggtaacaataaactggcttggtaccagcaacgtcctgggcaggcaccgcgcttactcatttacggagcctcttcacgtcccagcggggtagcggatcgtttctccggttctggcagcggcactgatttcaccttaacaatctcgcgtctggaaccggaagattttgccgtctattactgtcagcaatacggccagtccttgtctacatttggccagggaacgaaagtggaggtaaaacgtaccgttgctgcccccagtgttttcatctttccaccgtcagacgagcagctgaagtctggtaccgcaagtgtggtttgcctcctgaataacttttatcctcgcgaagcgaaagttcagtggaaggtggataatgccctgcagtcgggtaatagccaggaaagcgtgaccgaacaagattcaaaagactccacatattctctgagttcgactcttacgttaagcaaagctgactatgaaaagcacaaagtttatgcatgcgaggtgacgcatcagggtctttccagcccagtaactaaatcattcaaccgcggcgaatgttaattaataaggaggatataattatgaaaaagacagctatcgcgattgcagtggcactggctggtttcgctaccgtagcccaggcggccgcacaggtgcaactggtgcagagtggggccgaagttaaacgcccaggttcgtccgtaaccgtctcatgcaaggccagcggtggctctttctctacgtacgcgctgtcctgggttcgtcaggccccgggtcgtggacttgaatggatgggcggcgtaataccgctgctcaccatcactaattacgcaccgcgtttccagggccgcattacaatcaccgcggaccgttcgacctcaacggcatatctcgagttaaactcactgcgtcctgaagataccgcagtgtattactgcgctcgtgaaggtaccactggctggggctggttgggtaaaccgattggtgcgttcgcacattgggggcaaggcacacttgttactgtcagctctgcctctacgaaaggaccgagcgtctttcccttggctccaagtagcaaatcaacgagcggagggacagccgcgttaggatgtctggtgaaggactattttccggaaccagttaccgtcagttggaactcgggcgcgttaacttccggtgttcacacatttcccgctgttctgcaaagtagcggtctgtattccctgtcctcagtagtgacagttccttcgagttctctgggcactcagacctatatttgcaatgtgaaccataaacctagcaatacgaaagtggataagaaagtagagccgaaatcttgtctgcgatcgcggccaggccggccgcaccatcaccatcaccatggcgcatacccgtacgacgttccggactacgcttctactagttagaagggtggtggctctgagggtggcggttctgagggtggcggctctgagggaggcggttccggtggtggctctggttccggtgattttgattatgaaaagatggcaaacgctaataagggggctatgaccgaaaatgccgatgaaaacgcgctacagtctgacgctaaaggcaaacttgattctgtcgctactgattacggtgctgctatcgatggtttcattggtgacgtttccggccttgctaatggtaatggtgctactggtgattttgctggctctaattcccaaatggctcaagtcggtgacggtgataattcacctttaatgaataatttccgtcaatatttaccttccctccctcaatcggttgaatgtcgcccttttgtctttggcgctggtaaaccatatgaattttctattgattgtgacaaaataaacttattccgtggtgtctttgcgtttcttttatatgttgccacctttatgtatgtattttctacgtttgctaacatactgcgtaataaggagtcttaagctagctaacgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttag

SEQ ID NO: 87 - DNA, 25 bp, Artificial Sequence
  5' LVKappa1/2 Forward Primer
atgaggstcccygctcagctgctgg

SEQ ID NO: 88 - DNA, 28 bp, Artificial Sequence
  5' LVKappa3 Forward Primer
ctcttcctcctgctactctggctcccag

SEQ ID NO: 89 - DNA, 25 bp, Artificial Sequence
  5' LVKappa4 Forward Primer
atttctctgttgctctggatctctg

SEQ ID NO: 90 - DNA, 26 bp, Artificial Sequence
  VK-rev Reverse Primer
gcactctcccctgttgaagctctttg

SEQ ID NO: 91 - DNA, 24 bp, Artificial Sequence
  5' L-VH1 Forward Primer
acaggtgcccactcccaggtgcag

SEQ ID NO: 92 - DNA, 23 bp, Artificial Sequence
  5' L-VH3 Forward Primer
aaggtgtccagtgtgargtgcag

SEQ ID NO: 93 - DNA, 27 bp, Artificial Sequence
  5' L-VH4/6 Forward Primer
cccagatgggtcctgtcccaggtgcag

SEQ ID NO: 94 - DNA, 24 bp, Artificial Sequence
  5' L-VH5 Forward Primer
caaggagtctgttccgaggtgcag

SEQ ID NO: 95 - DNA, 23 bp, Artificial Sequence
  3' CgammaCH1 Reverse Primer
ggaaggtgtgcacgccgctggtc

SEQ ID NO: 96 - DNA, 6 bp, Artificial Sequence
  SalI restriction site
gtcgac

SEQ ID NO: 97 - DNA, 32 bp, Artificial Sequence
  3' SalIJH 1/2/4/5 Forward Primer
tgcgaagtcgacgctgaggagacggtgaccag

SEQ ID NO: 98 - DNA, 34 bp, Artificial Sequence
  3' SalIJH3 Forward Primer
tgcgaagtcgacgctgaagagacggtgaccattg

SEQ ID NO: 99 - DNA, 33 bp, Artificial Sequence
  3' SalIJH6 Forward Primer
tgcgaagtcgacgctgaggagacggtgaccgtg

SEQ ID NO: 100 - DNA, 118 bp, Artificial Sequence
  Fab Linker
gagcttcaacaggggagagtgctaattaattaataaggaggatataattatgaaaaagacagctatcgcgattgcagtggcactggctggctttgctaccgtagcgcaggcggccgca

SEQ ID NO: 101 - DNA, 391 bp, Artificial Sequence
  CH1 fragment
gtcgaccaaaggtccgtctgttttcccgctggctccgtcttctaaatctacctctggtggtaccgctgctctgggttgcctggttaaagactacttcccggaaccggttaccgtttcttggaactctggtgctctgacctctggtgttcacaccttcccggctgttctgcagtcttctggtctgtactctctgtcttctgttgttaccgttccgtcttcttctctgggtacccagacctacatctgcaacgttaaccacaaaccgtctaacaccaaagttgacaagaaagttgaaccgaaatcttgcctgcgatcgcggccaggccggccgcaccatcaccatcaccatggcgcatacccgtacgacgttccggactacgcttctactagt

SEQ ID NO: 102 - DNA, 5432 bp, Artificial Sequence
  pCALM Expression Vector
atgcattagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgattacgccaagctcgaaattaaccctcactaaagggaacaaaagctggagctccaccgcggtggcggccgcccaccatggactggacctggcggatcctgttcctggtggccgcggccaccggggcccacagcaaagggaaagggaaaggggctagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaacgggccaagcgggcacccgtgaagcagaccctgaacttcgacctgctgaagctggccggcgacgtggagagcaaccccggccccatgaggctccctgctcagctcctggggctgctaatgctctgggtccctggctcgagtgagaaagggaaagggaaataaggtaccaggtaagtgtacccaattcgccctatagtgagtcgtattacaattcactcgatcgcccttcccaacagttgcgcagcctgaatggcgaatggagatccaatttttaagtgtataatgtgttaaactactgattctaattgtttgtgtattttagattcacagtcccaaggctcatttcaggcccctcagtcctcacagtctgttcatgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgtaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagaatcctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagaacatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagaacttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccctagggggaggctaactgaaacacggaaggagacaataccggaaggaacccgcgctatgacggcaataaaaagacagaataaaacgcacggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcctcaggttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcc

SEQ ID NO: 103 - protein, 450 aa, Artificial Sequence
  Synagis VH chain
QVTLRESGPALVKPTQTLTLTCTFSGFSLSTSGMSVGWIRQPPGKALEWLADIWWDDKKDYNPSLKSRLTISKDTSKNQVVLKVTNMDPADTATYYCARSMITNWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 104 - protein, 120 aa, Artificial Sequence
  Synagis VH domain
QVTLRESGPALVKPTQTLTLTCTFSGFSLSTSGMSVGWIRQPPGKALEWLADIWWDDKKDYNPSLKSRLTISKDTSKNQVVLKVTNMDPADTATYYCARSMITNWYFDVWGAGTTVTVSS

SEQ ID NO: 105 - protein, 7 aa, Artificial Sequence
  Synagis VH CDR1
TSGMSVG

SEQ ID NO: 106 - protein, 16 aa, Artificial Sequence
  Synagis VH CDR2
DIWWDDKKDYNPSLKS

SEQ ID NO: 107 - protein, 10 aa, Artificial Sequence
  Synagis VH CDR3
SMITNWYFDV

SEQ ID NO: 108 - protein, 213 aa, Artificial Sequence
  Synagis VL chain
DIQMTQSPSTLSASVGDRVTITCKCQLSVGYMHWYQQKPGKAPKLLIYDTSKLASGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 109 - protein, 106 aa, Artificial Sequence
  Synagis VL domain
DIQMTQSPSTLSASVGDRVTITCKCQLSVGYMHWYQQKPGKAPKLLIYDTSKLASGVPSRFSGSGSGTEFTLTISSLQPDDFATYYCFQGSGYPFTFGGGTKLEIK

SEQ ID NO: 110 - protein, 10 aa, Artificial Sequence
  Synagis VL CDR1
KCQLSVGYMH

SEQ ID NO: 111 - protein, 7 aa, Artificial Sequence
  Synagis VL CDR2
DTSKLAS

SEQ ID NO: 112 - protein, 9 aa, Artificial Sequence
  Synagis VL CDR3
FQGSGYPFT

SEQ ID NO: 113 - protein, 450 aa, Artificial Sequence
  AFFF VH CHAIN
QVTLRESGPALVKPTQTLTLTCTFSGFSLSTAGMSVGWIRQPPGKALEWLADIWWDDKKDYNPSLKSRLTISKDTSKNQVVLKVTNMDPADTATYYCARSMITNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 114 - protein, 120 aa, Artificial Sequence
  AFFF VH DOMAIN
QVTLRESGPALVKPTQTLTLTCTFSGFSLSTAGMSVGWIRQPPGKALEWLADIWWDDKKDYNPSLKSRLTISKDTSKNQVVLKVTNMDPADTATYYCARSMITNFYFDVWGAGTTVTVSS

SEQ ID NO: 115 - protein, 7 aa, Artificial Sequence
  AFFF VH CDR1
TAGMSVG

SEQ ID NO: 116 - protein, 10 aa, Artificial Sequence
  AFFF VH CDR3
SMITNFYFDV

SEQ ID NO: 117 - protein, 213 aa, Artificial Sequence
  AFFF VL CHAIN
DIQMTQSPSTLSASVGDRVTITCSASSSVGYMHWYQQKPGKAPKLLIYDTFKLASGVPSRFSGSGSGTEFTLTISSLQPDDFATYYCFQFSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 118 - protein, 106 aa, Artificial Sequence
  AFFF VL DOMAIN
DIQMTQSPSTLSASVGDRVTITCSASSSVGYMHWYQQKPGKAPKLLIYDTFKLASGVPSRFSGSGSGTEFTLTISSLQPDDFATYYCFQFSGYPFTFGGGTKLEIK

SEQ ID NO: 119 - protein, 10 aa, Artificial Sequence
  AFFF VL CDR1
SASSSVGYMH

SEQ ID NO: 120 - protein, 7 aa, Artificial Sequence
  AFFF VL CDR2
DTFKLAS

SEQ ID NO: 121 - protein, 9 aa, Artificial Sequence
  AFFF VL CDR3
FQFSGYPFT

SEQ ID NO: 122 - protein, 450 aa, Artificial Sequence
  P1212 VH CHAIN
QVTLRESGPALVKPTQTLTLTCTFSGFSLSTPGMSVGWIRQPPGKALEWLADIWWDDKKHYNPSLKDRLTISKDTSKNQVVLKVTNMDPADTATYYCARDMIFNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 123 - protein, 120 aa, Artificial Sequence
  P1212 VH DOMAIN
QVTLRESGPALVKPTQTLTLTCTFSGFSLSTPGMSVGWIRQPPGKALEWLADIWWDDKKHYNPSLKDRLTISKDTSKNQVVLKVTNMDPADTATYYCARDMIFNFYFDVWGAGTTVTVSS

SEQ ID NO: 124 - protein, 7 aa, Artificial Sequence
  P1212 VH CDR1
TPGMSVG

SEQ ID NO: 125 - protein, 16 aa, Artificial Sequence
  P1212 VH CDR2
DIWWDDKKHYNPSLKD

SEQ ID NO: 126 - protein, 10 aa, Artificial Sequence
  P1212 VH CDR3
DMIFNFYFDV

SEQ ID NO: 127 - protein, 213 aa, Artificial Sequence
  P1212 VL CHAIN
DIQMTQSPSTLSASVGDRVTITCSLSSRVGYMHWYQQKPGKAPKLLIYDTFYLSSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 128 - protein, 106 aa, Artificial Sequence
  P1212 VL DOMAIN
DIQMTQSPSTLSASVGDRVTITCSLSSRVGYMHWYQQKPGKAPKLLIYDTFYLSSGVPSRFSGSGSGTEFTLTISSLQPDDFATYYCFQGSGYPFTFGGGTKVEIK

SEQ ID NO: 129 - protein, 10 aa, Artificial Sequence
  P1212 VL CDR1
SLSSRVGYMH

SEQ ID NO: 130 - protein, 7 aa, Artificial Sequence
  P1212 VL CDR2
DTFYLSS

SEQ ID NO: 131 - protein, 450 aa, Artificial Sequence; identical to SEQ ID NO: 122
  P12f4 VH CHAIN

SEQ ID NO: 132 - protein, 120 aa, Artificial Sequence
  P12f4 VH DOMAIN
QVTLRESGPALVKPTQTLTLTCTFSGFSLSTPGMSVGWIRQPPGKALEWLADIWWDGKKHYNPSLKDRLTISKDTSKNQVVLKVTNMDPADTATYYCARDMIFNFYFDVWGQGTTVTVSS

SEQ ID NO: 133 - protein, 16 aa, Artificial Sequence
  P12f4 VH CDR2
DIWWDGKKHYNPSLKD

SEQ ID NO: 134 - protein, 208 aa, Artificial Sequence
  P12f4 VL CHAIN
DIQMTQSPSTLSASVGDRVTITCSLSSRVGYMHWYQQKPGKAPKLLIYDTRGLPSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSF

SEQ ID NO: 135 - protein, 106 aa, Artificial Sequence
  P12f4 VL DOMAIN
DIQMTQSPSTLSASVGDRVTITCSLSSRVGYMHWYQQKPGKAPKLLIYDTRGLPSGVPSRFSGSGSGTEFTLTISSLQPDDFATYYCFQGSGYPFTFGGGTKVEIK

SEQ ID NO: 136 - protein, 7 aa, Artificial Sequence
  P12f4 VL CDR2
DTRGLPS

SEQ ID NO: 137 - protein, 450 aa, Artificial Sequence
  P11d4 VH CHAIN
QVTLRESGPALVKPTQTLTLTCTFSGFSLSTPGMSVGWIRQPPGKALEWLADIWWDGKKHYNPSLKDRLTISKDTSKNQVVLKVTNMDPADTATYYCARDMIFNWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 138 - protein, 120 aa, Artificial Sequence
  P11d4 VH DOMAIN
QVTLRESGPALVKPTQTLTLTCTFSGFSLSTPGMSVGWIRQPPGKALEWLADIWWDGKKHYNPSLKDRLTISKDTSKNQVVLKVTNMDPADTATYYCARDMIFNWYFDVWGQGTTVTVSS

SEQ ID NO: 139 - protein, 10 aa, Artificial Sequence
  P11d4 VH CDR3
DMIFNWYFDV

SEQ ID NO: 140 - protein, 213 aa, Artificial Sequence
  P11d4 VL CHAIN
DIQMTQSPSTLSASVGDRVTITCSPSSRVGYMHWYQQKPGKAPKLLIYDTMRLASGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 141 - protein, 106 aa, Artificial Sequence
  P11d4 VL DOMAIN
DIQMTQSPSTLSASVGDRVTITCSPSSRVGYMHWYQQKPGKAPKLLIYDTMRLASGVPSRFSGSGSGTEFTLTISSLQPDDFATYYCFQGSGYPFTFGGGTKVEIK

SEQ ID NO: 142 - protein, 10 aa, Artificial Sequence
  P11d4 VL CDR1
SPSSRVGYMH

SEQ ID NO: 143 - protein, 7 aa, Artificial Sequence
  P11d4 VL CDR2
DTMRLAS

SEQ ID NO: 144 - protein, 450 aa, Artificial Sequence
  A1e9 VH CHAIN
QVTLRESGPALVKPTQTLTLTCTFSGFSLSTAGMSVGWIRQPPGKALEWLADIWWDGKKHYNPSLKDRLTISKDTSKNQVVLKVTNMDPADTATYYCARDMIFNWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 145 - protein, 120 aa, Artificial Sequence; identical to SEQ ID NO: 138
  A1e9 VH DOMAIN

SEQ ID NO: 146 - protein, 213 aa, Artificial Sequence
  A1e9 VL CHAIN
DIQMTQSPSTLSASVGDRVTITCSLSSRVGYMHWYQQKPGKAPKLLIYDTFKLSSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 147 - protein, 106 aa, Artificial Sequence
  A1e9 VL DOMAIN
DIQMTQSPSTLSASVGDRVTITCSLSSRVGYMHWYQQKPGKAPKLLIYDTFKLSSGVPSRFSGSGSGTEFTLTISSLQPDDFATYYCFQGSGYPFTFGGGTKVEIK

SEQ ID NO: 148 - protein, 7 aa, Artificial Sequence
  A1e9 VL CDR2
DTFKLSS

SEQ ID NO: 149 - protein, 450 aa, Artificial Sequence
  A12a6 VH CHAIN
QVTLRESGPALVKPTQTLTLTCTFSGFSLSTAGMSVGWIRQPPGKALEWLADIWWDGKKDYNPSLKDRLTISKDTSKNQVVLKVTNMDPADTATYYCARDMIFNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 150 - protein, 120 aa, Artificial Sequence
  A12a6 VH DOMAIN
QVTLRESGPALVKPTQTLTLTCTFSGFSLSTAGMSVGWIRQPPGKALEWLADIWWDGKKDYNPSLKDRLTISKDTSKNQVVLKVTNMDPADTATYYCARDMIFNFYFDVWGQGTTVTVSS

SEQ ID NO: 151 - protein, 16 aa, Artificial Sequence
  A12a6 VH CDR2
DIWWDGKKDYNPSLKD

SEQ ID NO: 152 - protein, 213 aa, Artificial Sequence
  A12a6 VL CHAIN
DIQMTQSPSTLSASVGDRVTITCSASSRVGYMHWYQQKPGKAPKLLIYDTFKLSSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 153 - protein, 106 aa, Artificial Sequence
  A12a6 VL DOMAIN
DIQMTQSPSTLSASVGDRVTITCSASSRVGYMHWYQQKPGKAPKLLIYDTFKLSSGVPSRFSGSGSGTEFTLTISSLQPDDFATYYCFQGSGYPFTFGGGTKVEIK

SEQ ID NO: 154 - protein, 10 aa, Artificial Sequence
  A12a6 VL CDR1
SASSRVGYMH

SEQ ID NO: 155 - protein, 450 aa, Artificial Sequence
  A13c4 VH CHAIN
QVTLRESGPALVKPTQTLTLTCTFSGFSLSTAGMSVGWIRQPPGKALEWLADIWWDGKKSYNPSLKDRLTISKDTSKNQVVLKVTNMDPADTATYYCARDMIFNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 156 - protein, 120 aa, Artificial Sequence
  A13c4 VH DOMAIN
QVTLRESGPALVKPTQTLTLTCTFSGFSLSTAGMSVGWIRQPPGKALEWLADIWWDGKKSYNPSLKDRLTISKDTSKNQVVLKVTNMDPADTATYYCARDMIFNFYFDVWGQGTTVTVSS

SEQ ID NO: 157 - protein, 16 aa, Artificial Sequence
  A13c4 VH CDR2
DIWWDGKKSYNPSLKD

SEQ ID NO: 158 - protein, 213 aa, Artificial Sequence
  A13c4 VL CHAIN
DIQMTQSPSTLSASVGDRVTITCSLSSRVGYMHWYQQKPGKAPKLLIYDTMYQSSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 159 - protein, 106 aa, Artificial Sequence
  A13c4 VL DOMAIN
DIQMTQSPSTLSASVGDRVTITCSLSSRVGYMHWYQQKPGKAPKLLIYDTMYQSSGVPSRFSGSGSGTEFTLTISSLQPDDFATYYCFQGSGYPFTFGGGTKVEIK

SEQ ID NO: 160 - protein, 7 aa, Artificial Sequence
  A13c4 VL CDR2
DTMYQSS

SEQ ID NO: 161 - protein, 450 aa, Artificial Sequence; identical to SEQ ID NO: 155
  A17d4 VH CHAIN

SEQ ID NO: 162 - protein, 120 aa, Artificial Sequence; identical to SEQ ID NO: 156
  A17d4 VH DOMAIN

SEQ ID NO: 163 - protein, 16 aa, Artificial Sequence
  A17d4 VH CDR2
DIWWDDKKSYNPSLKD

SEQ ID NO: 164 - protein, 213 aa, Artificial Sequence
  A17d4 VL CHAIN
DIQMTQSPSTLSASVGDRVTITCLPSSRVGYMHWYQQKPGKAPKLLIYDTMYQSSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 165 - protein, 106 aa, Artificial Sequence
  A17d4 VL DOMAIN
DIQMTQSPSTLSASVGDRVTITCLPSSRVGYMHWYQQKPGKAPKLLIYDTMYQASGVPSRFSGSGSGTEFTLTISSLQPDDFATYYCFQFSGYPFTFGGGTKLEIK

SEQ ID NO: 166 - protein, 10 aa, Artificial Sequence
  A17d4 VL CDR1
LPSSRVGYMH

SEQ ID NO: 167 - protein, 450 aa, Artificial Sequence
  A4B4 VH CHAIN
QVTLRESGPALVKPTQTLTLTCTFSGFSLSTAGMSVGWIRQPPGKALEWLADIWWDDKKHYNPSLKDRLTISKDTSKNQVVLKVTNMDPADTATYYCARDMIFNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 168 - protein, 120 aa, Artificial Sequence [sequence omitted]

SEQ ID NO: 169 - protein, 213 aa, Artificial Sequence
  A4B4 VL CHAIN
DIQMTQSPSTLSASVGDRVTITCSASSRVGYMHWYQQKPGKAPKLLIYDTFFLDSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 170 - protein, 106 aa, Artificial Sequence
  A4B4 VL DOMAIN
DIQMTQSPSTLSASVGDRVTITCSASSRVGYMHWYQQKPGKAPKLLIYDTFFLDSGVPSRFSGSGSGTEFTLTISSLQPDDFATYYCFQGSGYPFTFGGGTKLEIK

SEQ ID NO: 171 - protein, 7 aa, Artificial Sequence
  A4B4 VL CDR2
DTFFLDS

SEQ ID NO: 172 - protein, 450 aa, Artificial Sequence
  A8c7 VH CHAIN
QVTLRESGPALVKPTQTLTLTCTFSGFSLSTAGMSVGWIRQPPGKALEWLADIWWDDKKSYNPSLKDRLTISKDTSKNQVVLKVTNMDPADTATYYCARDMIFNWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 173 - protein, 120 aa, Artificial Sequence
  A8c7 VH DOMAIN
QVTLRESGPALVKPTQTLTLTCTFSGFSLSTAGMSVGWIRQPPGKALEWLADIWWDDKKSYNPSLKDRLTISKDTSKNQVVLKVTNMDPADTATYYCARDMIFNWYFDVWGQGTTVTVSS

SEQ ID NO: 174 - protein, 213 aa, Artificial Sequence
  A8c7 VL CHAIN
DIQMTQSPSTLSASVGDRVTITCSPSSRVGYMHWYQQKPGKAPKLLIYDTRYQSSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 175 - protein, 106 aa, Artificial Sequence
  A8c7 VL DOMAIN
DIQMTQSPSTLSASVGDRVTITCSASSRVGYMHWYQQKPGKAPKLLIYDTRYQSSGVPSRFSGSGSGTEFTLTISSLQPDDFATYYCFQGSGYPFTFGGGTKLEIK

SEQ ID NO: 176 - protein, 451 aa, Artificial Sequence
  IX-493L1FR VH CHAIN
QVTLRESGPALVKPTQTLTLTCTFSGFSLSTSGMSVGYWIRQPPGKALEWLADIWWDDKKDYNPSLKSRLTISKDTSKNQVVLKVTNMDPADTATYYCARSMITNWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 177 - protein, 213 aa, Artificial Sequence
  IX-493L1FR VL CHAIN
DIQMTQSPSTLSASVGDRVTITCSASSSVGYMHWYQQKPGKAPKLLIYDTSKLASGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 178 - protein, 106 aa, Artificial Sequence
  IX-493L1FR VL DOMAIN
DIQMTQSPSTLSASVGDRVTITCSASSSVGYMHWYQQKPGKAPKLLIYDTSKLASGVPSRFSGSGSGTEFTLTISSLQPDDFATYYCFQGSGYPFTFGGGTKLEIK

SEQ ID NO: 179 - protein, 450 aa, Artificial Sequence
  M3H9 VH CHAIN
QVTLRESGPALVKPTQTLTLTCTFSGFSLSTAGMSVGWIRQPPGKALEWLADIWWDDKKDYNPSLKSRLTISKDTSKNQVVLKVTNMDPADTATYYCARDMIFNWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 180 - protein, 213 aa, Artificial Sequence
  M3H9 VL CHAIN
DIQMTQSPSTLSASVGDRVTITCSASSSVGYMHWYQQKPGKAPKLLIYDTYKQTSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 181 - protein, 106 aa, Artificial Sequence
  M3H9 VL DOMAIN
DIQMTQSPSTLSASVGDRVTITCSASSSVGYMHWYQQKPGKAPKLLIYDTYKQTSGVPSRFSGSGSGTEFTLTISSLQPDDFATYYCFQGSGYPFTFGGGTKLEIK

SEQ ID NO: 182 - protein, 450 aa, Artificial Sequence; identical to SEQ ID NO: 179
  Y10H6 VH CHAIN

SEQ ID NO: 183 - protein, 213 aa, Artificial Sequence
  Y10H6 VL CHAIN
DIQMTQSPSTLSASVGDRVTITCSASSSVGYMHWYQQKPGKAPKLLIYDTRYLSSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 184 - protein, 106 aa, Artificial Sequence
  Y10H6 VL DOMAIN
DIQMTQSPSTLSASVGDRVTITCSASSSVGYMHWYQQKPGKAPKLLIYDTRYLSSGVPSRFSGSGSGTEFTLTISSLQPDDFATYYCFQGSGYPFTFGGGTKLEIK

SEQ ID NO: 185 - protein, 7 aa, Artificial Sequence
  Y10H6 VL CDR2
DTRYLSS

SEQ ID NO: 186 - protein, 450 aa, Artificial Sequence
  DG VH CHAIN
QVTLRESGPALVKPTQTLTLTCTFSGFSLSTAGMSVGWIRQPPGKALEWLADIWWDDKKDYNPSLKSRLTISKDTSKNQVVLKVTNMDPADTATYYCARDMITNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 187 - protein, 120 aa, Artificial Sequence
  DG VH DOMAIN
QVTLRESGPALVKPTQTLTLTCTFSGFSLSTAGMSVGWIRQPPGKALEWLADIWWDDKKDYNPSLKSRLTISKDTSKNQVVLKVTNMDPADTATYYCARDMITNFYFDVWGAGTTVTVSS

SEQ ID NO: 188 - protein, 10 aa, Artificial Sequence
  DG VH CDR3
DMITNFYFDV

SEQ ID NO: 189 - protein, 213 aa, Artificial Sequence
  DG VL CHAIN
DIQMTQSPSTLSASVGDRVTITCSASSSVGYMHWYQQKPGKAPKLLIYDTFKLASGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 190 - protein, 450 aa, Artificial Sequence; identical to SEQ ID NO: 113
  AFFF(1) VH CHAIN

SEQ ID NO: 191 - protein, 213 aa, Artificial Sequence
  AFFF(1) VL CHAIN
DIQMTQSPSTLSASVGDRVTITCSASSSVGYMHWYQQKPGKAPKLLIYDTFKLASGVPSRFSGSGSGTEFTLTISSLQPDDFATYYCFQGSFYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 192 - protein, 106 aa, Artificial Sequence
  AFFF(1) VL DOMAIN
DIQMTQSPSTLSASVGDRVTITCSASSSVGYMHWYQQKPGKAPKLLIYDTFKLASGVPSRFSGSGSGTEFTLTISSLQPDDFATYYCFQGSFYPFTFGGGTKLEIK

SEQ ID NO: 193 - protein, 9 aa, Artificial Sequence
  AFFF(1) VL CDR3
FQGSFYPFT

SEQ ID NO: 194 - protein, 450 aa, Artificial Sequence; identical to SEQ ID NO: 186
  6H8 VH CHAIN

SEQ ID NO: 195 - protein, 213 aa, Artificial Sequence
  6H8 VL CHAIN
DIQMTQSPSTLSASVGDRVTITCSASSSVGYMHWYQQKPGKAPKLLIYDTFKLTSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 196 - protein, 106 aa, Artificial Sequence
  6H8 VL DOMAIN
DIQMTQSPSTLSASVGDRVTITCSASSSVGYMHWYQQKPGKAPKLLIYDTFKLTSGVPSRFSGSGSGTEFTLTISSLQPDDFATYYCFQGSGYPFTFGGGTKLEIK

SEQ ID NO: 197 - protein, 7 aa, Artificial Sequence
  6H8 VL CDR2
DTFKLTS

SEQ ID NO: 198 - protein, 450 aa, Artificial Sequence; identical to SEQ ID NO: 186
  L1-7E5 VH CHAIN

SEQ ID NO: 199 - protein, 213 aa, Artificial Sequence
  L1-7E5 VL CHAIN
DIQMTQSPSTLSASVGDRVTITCSASSRVGYMHWYQQKPGKAPKLLIYDTFKLASGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 200 - protein, 106 aa, Artificial Sequence
  L1-7E5 VL DOMAIN
DIQMTQSPSTLSASVGDRVTITCSASSSVGYMHWYQQKPGKAPKLLIYDTFRLASGVPSRFSGSGSGTEFTLTISSLQPDDFATYYCFQGSGYPFTFGGGTKLEIK

SEQ ID NO: 201 - protein, 450 aa, Artificial Sequence; identical to SEQ ID NO: 186
  L2-15B10 VH CHAIN

SEQ ID NO: 202 - protein, 213 aa, Artificial Sequence
  L2-15B10 VL CHAIN
DIQMTQSPSTLSASVGDRVTITCSASSSVGYMHWYQQKPGKAPKLLIYDTFRLASGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 203 - protein, 106 aa, Artificial Sequence; identical to SEQ ID NO: 200
  L2-15B10 VL DOMAIN

SEQ ID NO: 204 - protein, 7 aa, Artificial Sequence
  L2-15B10 VL CDR2
DTFRLAS

SEQ ID NO: 205 - protein, 450 aa, Artificial Sequence
  A13a11 VH CHAIN
QVTLRESGPALVKPTQTLTLTCTFSGFSLSTAGMSVGWIRQPPGKALEWLADIWWDDKKHYNPSLKDRLTISKDTSKNQVVLKVTNMDPADTATYYCARSMITNWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 206 - protein, 120 aa, Artificial Sequence
  A13a11 VH DOMAIN
QVTLRESGPALVKPTQTLTLTCTFSGFSLSTAGMSVGWIRQPPGKALEWLADIWWDDKKHYNPSLKDRLTISKDTSKNQVVLKVTNMDPADTATYYCARDMIFNWYFDVWGAGTTVTVSS

SEQ ID NO: 207 - protein, 214 aa, Artificial Sequence
  A13a11 VL CHAIN
DIQMTQSPSTLSASVGDRVTITCSPSSRVGYMHWYQQKPGKAPKLLIYDTYRHLASGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 208 - protein, 106 aa, Artificial Sequence
  A13a11 VL DOMAIN
DIQMTQSPSTLSASVGDRVTITCSASSSVGYMHWYQQKPGKAPKLLIYDTYRHASGVPSRFSGSGSGTEFTLTISSLQPDDFATYYCFQGSGYPFTFGGGTKLEIK

SEQ ID NO: 209 - protein, 7 aa, Artificial Sequence
  A13a11 VL CDR2
DTYRHSS

SEQ ID NO: 210 - protein, 450 aa, Artificial Sequence; identical to SEQ ID NO: 144
  A1h5 VH CHAIN

SEQ ID NO: 211 - protein, 213 aa, Artificial Sequence
  A1h5 VL CHAIN
DIQMTQSPSTLSASVGDRVTITCSLSSSVGYMHWYQQKPGKAPKLLIYDTFFHRSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 212 - protein, 106 aa, Artificial Sequence
  A1h5 VL DOMAIN
DIQMTQSPSTLSASVGDRVTITCSLSSSVGYMHWYQQKPGKAPKLLIYDTFFHRSGVPSRFSGSGSGTEFTLTISSLQPDDFATYYCFQGSGYPFTFGGGTKLEIK

SEQ ID NO: 213 - protein, 10 aa, Artificial Sequence
  A1h5 VL CDR1
SLSSSVGYMH

SEQ ID NO: 214 - protein, 7 aa, Artificial Sequence
  A1h5 VL CDR2
DTFFHRS

SEQ ID NO: 215 - protein, 450 aa, Artificial Sequence; identical to SEQ ID NO: 167
  A4B4(1) VH CHAIN

SEQ ID NO: 216 - protein, 213 aa, Artificial Sequence
  A4B4(1) VL CHAIN
DIQMTQSPSTLSASVGDRVTITCSASSRVGYMHWYQQKPGKAPKLLIYDTLLLDSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 217 - protein, 106 aa, Artificial Sequence
  A4B4(1) VL DOMAIN
DIQMTQSPSTLSASVGDRVTITCSASSRVGYMHWYQQKPGKAPKLLIYDTLLLDSGVPSRFSGSGSGTEFTLTISSLQPDDFATYYCFQGSGYPFTFGGGTKLEIK

SEQ ID NO: 218 - protein, 7 aa, Artificial Sequence
  A4B4(1) VL CDR2
DTLLLDS

SEQ ID NO: 219 - protein, 450 aa, Artificial Sequence; identical to SEQ ID NO: 167
  A4B4L1 VH CHAIN

SEQ ID NO: 220 - protein, 213 aa, Artificial Sequence
  A4B4L1 VL CHAIN
DIQMTQSPSTLSASVGDRVTITCSASSRVGYMHWYQQKPGKAPKLLIYDTSKLASGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 221 - protein, 106 aa, Artificial Sequence
  A4B4L1 VL DOMAIN
DIQMTQSPSTLSASVGDRVTITCSASSRVGYMHWYQQKPGKAPKLLIYDTSKLASGVPSRFSGSGSGTEFTLTISSLQPDDFATYYCFQGSGYPFTFGGGTKLEIK

SEQ ID NO: 222 - protein, 450 aa, Artificial Sequence; identical to SEQ ID NO: 167
  A4B4-F25S VH CHAIN

SEQ ID NO: 223 - protein, 213 aa, Artificial Sequence
  A4B4-F25S VL CHAIN
DIQMTQSPSTLSASVGDRVTITCSASSRVGYMHWYQQKPGKAPKLLIYDTSFLDSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 224 - protein, 106 aa, Artificial Sequence
  A4B4-F25S VL DOMAIN
DIQMTQSPSTLSASVGDRVTITCSASSRVGYMHWYQQKPGKAPKLLIYDTSFLDSGVPSRFSGSGSGTEFTLTISSLQPDDFATYYCFQGSGYPFTFGGGTKLEIK

SEQ ID NO: 225 - protein, 7 aa, Artificial Sequence
  A4B4-F25S VL CDR2
DTSFLDS

SEQ ID NO: 226 - protein, 16 aa, Artificial Sequence
  VH CDR2
DIWWDDKKHYNPSLKS

SEQ ID NO: 227 - protein, 16 aa, Artificial Sequence
  VH CDR2
DIWWDDKKDYNPSLKD

SEQ ID NO: 228 - protein, 16 aa, Artificial Sequence
  VH CDR2
DIWWDDKKHYNPSLKS

SEQ ID NO: 229 - protein, 16 aa, Artificial Sequence
  VH CDR2
DIWWDDKKDYNPSLKD

SEQ ID NO: 230 - protein, 16 aa, Artificial Sequence
  VH CDR2
DIWWDGKKDYNPSLKS

SEQ ID NO: 231 - protein, 16 aa, Artificial Sequence
  VH CDR2
DIWWDGKKDYNPSLKD

SEQ ID NO: 232 - protein, 16 aa, Artificial Sequence
  VH CDR2
DIWWDGKKHYNPSLKS

SEQ ID NO: 233 - protein, 16 aa, Artificial Sequence
  VH CDR2
DIWWDDKKSYNPSLKS

SEQ ID NO: 234 - protein, 16 aa, Artificial Sequence
  VH CDR2
DIWWDDKKSYNPSLKD

SEQ ID NO: 235 - protein, 16 aa, Artificial Sequence
  VH CDR2
DIWWDGKKSYNPSLKS

SEQ ID NO: 236 - protein, 10 aa, Artificial Sequence
  VH CDR3
DMITNWYFDV

SEQ ID NO: 237 - protein, 10 aa, Artificial Sequence
  VH CDR3
SMIFNWYFDV

SEQ ID NO: 238 - protein, 10 aa, Artificial Sequence
  VH CDR3
SMIFNFYFDV

SEQ ID NO: 239 - protein, 10 aa, Artificial Sequence
  VL CDR1
KCQSSVGYMH

SEQ ID NO: 240 - protein, 10 aa, Artificial Sequence
  VL CDR1
KCQSRVGYMH

SEQ ID NO: 241 - protein, 10 aa, Artificial Sequence
  VL CDR1
KCQLRVGYMH

SEQ ID NO: 242 - protein, 10 aa, Artificial Sequence
  VL CDR1
KLQLSVGYMH

SEQ ID NO: 243 - protein, 10 aa, Artificial Sequence
  VL CDR1
KLQSSVGYMH

SEQ ID NO: 244 - protein, 10 aa, Artificial Sequence
  VL CDR1
KLQSRVGYMH

SEQ ID NO: 245 - protein, 10 aa, Artificial Sequence
  VL CDR1
KLQLRVGYMH

SEQ ID NO: 246 - protein, 10 aa, Artificial Sequence
  VL CDR1
KLSLSVGYMH

SEQ ID NO: 247 - protein, 10 aa, Artificial Sequence
  VL CDR1
KLSSSVGYMH

SEQ ID NO: 248 - protein, 10 aa, Artificial Sequence
  VL CDR1
KLSSRVGYMH

SEQ ID NO: 249 - protein, 10 aa, Artificial Sequence
  VL CDR1
KLSLRVGYMH

SEQ ID NO: 250 - protein, 10 aa, Artificial Sequence
  VL CDR1
KCSLSVGYMH

SEQ ID NO: 251 - protein, 10 aa, Artificial Sequence
  VL CDR1
KCSSSVGYMH

SEQ ID NO: 252 - protein, 10 aa, Artificial Sequence
  VL CDR1
KCSSRVGYMH

SEQ ID NO: 253 - protein, 10 aa, Artificial Sequence
  VL CDR1
KCSLRVGYMH

SEQ ID NO: 254 - protein, 10 aa, Artificial Sequence
  VL CDR1
SLSLSVGYMH

SEQ ID NO: 255 - protein, 10 aa, Artificial Sequence
  VL CDR1
SLSSSVGYMH

SEQ ID NO: 256 - protein, 10 aa, Artificial Sequence
  VL CDR1
SLSSRVGYMH

SEQ ID NO: 257 - protein, 10 aa, Artificial Sequence
  VL CDR1
SLSLRVGYMH

SEQ ID NO: 258 - protein, 10 aa, Artificial Sequence
  VL CDR1
SCQLSVGYMH

SEQ ID NO: 259 - protein, 10 aa, Artificial Sequence
  VL CDR1
SCQSSVGYMH

SEQ ID NO: 260 - protein, 10 aa, Artificial Sequence
  VL CDR1
SCQSRVGYMH

SEQ ID NO: 261 - protein, 10 aa, Artificial Sequence
  VL CDR1
SCQLRVGYMH

SEQ ID NO: 262 - protein, 10 aa, Artificial Sequence
  VL CDR1
SLQLSVGYMH

SEQ ID NO: 263 - protein, 10 aa, Artificial Sequence
  VL CDR1
SLQSSVGYMH

SEQ ID NO: 264 - protein, 10 aa, Artificial Sequence
  VL CDR1
SLQSRVGYMH

SEQ ID NO: 265 - protein, 10 aa, Artificial Sequence
  VL CDR1
SLQLRVGYMH

SEQ ID NO: 266 - protein, 10 aa, Artificial Sequence
  VL CDR1
SCSLSVGYMH

SEQ ID NO: 267 - protein, 10 aa, Artificial Sequence
  VL CDR1
SCSSSVGYMH

SEQ ID NO: 268 - protein, 10 aa, Artificial Sequence
  VL CDR1
SCSSRVGYMH

SEQ ID NO: 269 - protein, 10 aa, Artificial Sequence
  VL CDR1
SCSLRVGYMH

SEQ ID NO: 270 - protein, 10 aa, Artificial Sequence
  VL CDR1
KPSSRVGYMH

SEQ ID NO: 271 - protein, 10 aa, Artificial Sequence
  VL CDR1
KPSLRVGYMH

SEQ ID NO: 272 - protein, 10 aa, Artificial Sequence
  VL CDR1
KPSSSVGYMH

SEQ ID NO: 273 - protein, 10 aa, Artificial Sequence
  VL CDR1
KPSLSVGYMH

SEQ ID NO: 274 - protein, 10 aa, Artificial Sequence
  VL CDR1
KPQSRVGYMH

SEQ ID NO: 275 - protein, 10 aa, Artificial Sequence
  VL CDR1
KPQLRVGYMH

SEQ ID NO: 276 - protein, 10 aa, Artificial Sequence
  VL CDR1
KPQSSVGYMH

SEQ ID NO: 277 - protein, 10 aa, Artificial Sequence
  VL CDR1
KPQLSVGYMH

SEQ ID NO: 278 - protein, 10 aa, Artificial Sequence
  VL CDR1
SPSLRVGYMH

SEQ ID NO: 279 - protein, 10 aa, Artificial Sequence
  VL CDR1
SPSSSVGYMH

SEQ ID NO: 280 - protein, 10 aa, Artificial Sequence
  VL CDR1
SPSLSVGYMH

SEQ ID NO: 281 - protein, 10 aa, Artificial Sequence
  VL CDR1
SPQSRVGYMH

SEQ ID NO: 282 - protein, 10 aa, Artificial Sequence
  VL CDR1
SPQLRVGYMH

SEQ ID NO: 283 - protein, 10 aa, Artificial Sequence
  VL CDR1
SPQSSVGYMH

SEQ ID NO: 284 - protein, 10 aa, Artificial Sequence
  VL CDR1
SPQLSVGYMH

SEQ ID NO: 285 - protein, 10 aa, Artificial Sequence
  VL CDR1
KAQSRVGYMH

SEQ ID NO: 286 - protein, 10 aa, Artificial Sequence
  VL CDR1
KAQLRVGYMH

SEQ ID NO: 287 - protein, 10 aa, Artificial Sequence
  VL CDR1
KAQSSVGYMH

SEQ ID NO: 288 - protein, 10 aa, Artificial Sequence
  VL CDR1
KAQLSVGYMH

SEQ ID NO: 289 - protein, 10 aa, Artificial Sequence
  VL CDR1
KASSRVGYMH

SEQ ID NO: 290 - protein, 10 aa, Artificial Sequence
  VL CDR1
KASLRVGYMH

SEQ ID NO: 291 - protein, 10 aa, Artificial Sequence
  VL CDR1
KASSSVGYMH

SEQ ID NO: 292 - protein, 10 aa, Artificial Sequence
  VL CDR1
KASLSVGYMH

SEQ ID NO: 293 - protein, 10 aa, Artificial Sequence
  VL CDR1
SASLRVGYMH

SEQ ID NO: 294 - protein, 10 aa, Artificial Sequence
  VL CDR1
SASLSVGYMH

SEQ ID NO: 295 - protein, 10 aa, Artificial Sequence
  VL CDR1
SAQSRVGYMH

SEQ ID NO: 296 - protein, 10 aa, Artificial Sequence
  VL CDR1
SAQLRVGYMH

SEQ ID NO: 297 - protein, 10 aa, Artificial Sequence
  VL CDR1
SAQSSVGYMH

SEQ ID NO: 298 - protein, 10 aa, Artificial Sequence
  VL CDR1
LPSSRVGYMH

SEQ ID NO: 299 - protein, 10 aa, Artificial Sequence
  VL CDR1
LPSLSVGYMH

SEQ ID NO: 300 - protein, 10 aa, Artificial Sequence
  VL CDR1
LPSSSVGYMH

SEQ ID NO: 301 - protein, 10 aa, Artificial Sequence
  VL CDR1
LPSLRVGYMH

SEQ ID NO: 302 - protein, 10 aa, Artificial Sequence
  VL CDR1
LCSSRVGYMH

SEQ ID NO: 303 - protein, 10 aa, Artificial Sequence
  VL CDR1
LCSLSVGYMH

SEQ ID NO: 304 - protein, 10 aa, Artificial Sequence
  VL CDR1
LCSSSVGYMH

SEQ ID NO: 305 - protein, 10 aa, Artificial Sequence
  VL CDR1
LCSLRVGYMH

SEQ ID NO: 306 - protein, 10 aa, Artificial Sequence
  VL CDR1
LPQSRVGYMH

SEQ ID NO: 307 - protein, 10 aa, Artificial Sequence
  VL CDR1
LPQLSVGYMH

SEQ ID NO: 308 - protein, 10 aa, Artificial Sequence
  VL CDR1
LPQSSVGYMH

SEQ ID NO: 309 - protein, 10 aa, Artificial Sequence
  VL CDR1
LPQLRVGYMH

SEQ ID NO: 310 - protein, 10 aa, Artificial Sequence
  VL CDR1
LCQSRVGYMH

SEQ ID NO: 311 - protein, 10 aa, Artificial Sequence
  VL CDR1
LCQLSVGYMH

SEQ ID NO: 312 - protein, 10 aa, Artificial Sequence
  VL CDR1
LCQSSVGYMH

SEQ ID NO: 313 - protein, 10 aa, Artificial Sequence
  VL CDR1
LCQLRVGYMH

SEQ ID NO: 314 - protein, 10 aa, Artificial Sequence
  VL CDR1
SAQLSVGYMH

SEQ ID NO: 315 - protein, 7 aa, Artificial Sequence
  VL CDR2
DTSYLAS

SEQ ID NO: 316 - protein, 7 aa, Artificial Sequence
  VL CDR2
DTSYLSS

SEQ ID NO: 317 - protein, 7 aa, Artificial Sequence
  VL CDR2
DTKKLSS

SEQ ID NO: 318 - protein, 7 aa, Artificial Sequence
  VL CDR2
DTFYLSS

SEQ ID NO: 319 - protein, 7 aa, Artificial Sequence
  VL CDR2
DTFKLSS

SEQ ID NO: 320 - protein, 7 aa, Artificial Sequence
  VL CDR2
DTFYLAS

SEQ ID NO: 321 - protein, 7 aa, Artificial Sequence
  VL CDR2
DTSKLPS

SEQ ID NO: 322 - protein, 7 aa, Artificial Sequence
  VL CDR2
DTSGLAS

SEQ ID NO: 323 - protein, 7 aa, Artificial Sequence
  VL CDR2
DTSGLPS

SEQ ID NO: 324 - protein, 7 aa, Artificial Sequence
  VL CDR2
DTRKLAS

SEQ ID NO: 325 - protein, 7 aa, Artificial Sequence
  VL CDR2
DTRGLAS

SEQ ID NO: 326 - protein, 7 aa, Artificial Sequence
  VL CDR2
DTRKLPS

SEQ ID NO: 327 - protein, 7 aa, Artificial Sequence
  VL CDR2
DTMKLAS

SEQ ID NO: 328 - protein, 7 aa, Artificial Sequence
  VL CDR2
DTSRLAS

SEQ ID NO: 329 - protein, 7 aa, Artificial Sequence
  VL CDR2
DTSLLAS

SEQ ID NO: 330 - protein, 7 aa, Artificial Sequence
  VL CDR2
DTSLLDS

SEQ ID NO: 331 - protein, 7 aa, Artificial Sequence
  VL CDR2
DTSKLDS

SEQ ID NO: 332 - protein, 7 aa, Artificial Sequence
  VL CDR2
DTLKLDS

SEQ ID NO: 333 - protein, 7 aa, Artificial Sequence
  VL CDR2
DTLLLAS

SEQ ID NO: 334 - protein, 7 aa, Artificial Sequence
  VL CDR2
DTLKLAS

SEQ ID NO: 335 - protein, 7 aa, Artificial Sequence
  VL CDR2
DTSKLSS

SEQ ID NO: 336 - protein, 7 aa, Artificial Sequence
  VL CDR2
DTSKQAS

SEQ ID NO: 337 - protein, 7 aa, Artificial Sequence
  VL CDR2
DTSKQSS

SEQ ID NO: 338 - protein, 7 aa, Artificial Sequence
  VL CDR2
DTSYLAS

SEQ ID NO: 339 - protein, 7 aa, Artificial Sequence
  VL CDR2
DTSYLSS

SEQ ID NO: 340 - protein, 7 aa, Artificial Sequence
  VL CDR2
DTSYQAS

SEQ ID NO: 341 - protein, 7 aa, Artificial Sequence
  VL CDR2
DTSYQSS

SEQ ID NO: 342 - protein, 7 aa, Artificial Sequence
  VL CDR2
DTMYQAS

SEQ ID NO: 343 - protein, 7 aa, Artificial Sequence
  VL CDR2
DTMKQAS

SEQ ID NO: 344 - protein, 7 aa, Artificial Sequence
  VL CDR2
DTMKQSS

SEQ ID NO: 345 - protein, 7 aa, Artificial Sequence
  VL CDR2
DTMYLAS

SEQ ID NO: 346 - protein, 7 aa, Artificial Sequence
  VL CDR2
DTMYLSS

SEQ ID NO: 347 - protein, 7 aa, Artificial Sequence
  VL CDR2
DTMKLAS

SEQ ID NO: 348 - protein, 7 aa, Artificial Sequence
  VL CDR2
DTMKLSS

SEQ ID NO: 349 - protein, 7 aa, Artificial Sequence
  VL CDR2
DTSKLSS

SEQ ID NO: 350 - protein, 7 aa, Artificial Sequence
  VL CDR2
DTRYQAS

SEQ ID NO: 351 - protein, 7 aa, Artificial Sequence
  VL CDR2
DTRKQAS

SEQ ID NO: 352 - protein, 7 aa, Artificial Sequence
  VL CDR2
DTRKQSS

SEQ ID NO: 353 - protein, 7 aa, Artificial Sequence
  VL CDR2
DTRKLAS

SEQ ID NO: 354 - protein, 7 aa, Artificial Sequence
  VL CDR2
DTRKLSS

SEQ ID NO: 355 - protein, 7 aa, Artificial Sequence
  VL CDR2
DTRYLAS

SEQ ID NO: 356 - protein, 450 aa, Artificial Sequence; identical to SEQ ID NO: 179
  H3-3F4 VH CHAIN

SEQ ID NO: 357 - protein, 120 aa, Artificial Sequence
  H3-3F4 VH DOMAIN
QVTLRESGPALVKPTQTLTLTCTFSGFSLSTAGMSVGWIRQPPGKALEWLADIWWDDKKDYNPSLKSRLTISKDTSKNQVVLKVTNMDPADTATYYCARDMIFNWYFDVWGAGTTVTVSS

SEQ ID NO: 358 - protein, 213 aa, Artificial Sequence; identical to SEQ ID NO: 189
  H3-3F4 VL CHAIN

SEQ ID NO: 359 - protein, 106 aa, Artificial Sequence
  H3-3F4 VL DOMAIN
DIQMTQSPSTLSASVGDRVTITCSASSSVGYMHWYQQKPGKAPKLLIYDTFKLASGVPSRFSGSGSGTEFTLTISSLQPDDFATYYCFQGSGYPFTFGGGTKLEIK

SEQ ID NO: 360 - protein, 7 aa, Artificial Sequence
  VL CDR2
DTRYQSS

SEQ ID NO: 361 - protein, 7 aa, Artificial Sequence
  M3H9 VL CDR2
DTYKQTS

SEQ ID NO: 362 - protein, 120 aa, Artificial Sequence
  IX-493L1FR VH domain
QVTLRESGPALVKPTQTLTLTCTFSGFSLSTSGMSVGWIRQPPGKALEWLADIWWDDKKDYNPSLKSRLTISKDTSKNQVVLKVTNMDPADTATYYCARSMITNWYFDVWGQGTTVTVSS

SEQ ID NO: 363 - protein, 450 aa, Artificial Sequence
  A3e2 VH chain
QVTLRESGPALVKPTQTLTLTCTFSGFSLSTAGMSVGWIRQPPGKALEWLADIWWGDKGHYNPSLKDRLTISKDTSKNQVVLKVTNMDPADTATYYCARDMIFNWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 364 - protein, 120 aa, Artificial Sequence
  A3e2 VH domain
QVTLRESGPALVKPTQTLTLTCTFSGFSLSTAGMSVGWIRQPPGKALEWLADIWWGDKGHYNPSLKDRLTISKDTSKNQVVLKVTNMDPADTATYYCARDMIFNWYFDVWGQGTTVTVSS

SEQ ID NO: 365 - protein, 16 aa, Artificial Sequence
  A3e2 VH CDR2
DIWWGDKGHYNPSLKD

SEQ ID NO: 366 - protein, 213 aa, Artificial Sequence
  A3e2 VL chain
DIQMTQSPSTLSASVGDRVTITCSASSSVGYMHWYQQKPGKAPKLLIYDTFYLHSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 367 - protein, 106 aa, Artificial Sequence
  A3e2 VL domain
DIQMTQSPSTLSASVGDRVTITCSASSSVGYMHWYQQKPGKAPKLLIYDTFYLHSGVPSRFSGSGSGTEFTLTISSLQPDDFATYYCFQGSGYPFTFGGGTKVEIK

SEQ ID NO: 368 - protein, 7 aa, Artificial Sequence
  A3e2 VL CDR2
DTFYLHS

SEQ ID NO: 369 - protein, 450 aa, Artificial Sequence
  A14a4 VH chain
QVTLRESGPALVKPTQTLTLTCTFSGFSLSTAGMSVGWIRQPPGKALEWLADIWWDDKKSYNPSLKDRLTISKDTSKNQVVLKVTNMDPADTATYYCARDMITNWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 370 - protein, 120 aa, Artificial Sequence
  A14a4 VH domain
QVTLRESGPALVKPTQTLTLTCTFSGFSLSTAGMSVGWIRQPPGKALEWLADIWWDDKKSYNPSLKDRLTISKDTSKNQVVLKVTNMDPADTATYYCARDMITNWYFDVWGQGTTVTVSS

SEQ ID NO: 371 - protein, 10 aa, Artificial Sequence
  A14a4 VH CDR3
DMITNWYFDV

SEQ ID NO: 372 - protein, 197 aa, Artificial Sequence
  A14a4 VL chain
DRVTITCLLSSRVGYMHWYQQKPGKAPKLLIYDTYYQTSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 373 - protein, 106 aa, Artificial Sequence
  A14a4 VL domain
DIQMTQSPSTLSASVGDRVTITCLLSSRVGYMHWYQQKPGKAPKLLIYDTYYQTSGVPSRFSGSGSGTEFTLTISSLQPDDFATYYCFQGSGYPFTFGGGTKVEIK

SEQ ID NO: 374 - protein, 10 aa, Artificial Sequence
  A14a4 VL CDR1
LLSSRVGYMH

SEQ ID NO: 375 - protein, 7 aa, Artificial Sequence
  A14a4 VL CDR2
DTYYQTS

SEQ ID NO: 376 - protein, 450 aa, Artificial Sequence
  A16b4 VH chain
QVTLRESGPALVKPTQTLTLTCTFSGFSLSTAGMSVGWIRQPPGKALEWLADIWWDDKKHYNPSLKDRLTISKDTSKNQVVLKVTNMDPADTATYYCARDMIFNWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 377 - protein, 120 aa, Artificial Sequence
  A16b4 VH domain
QVTLRESGPALVKPTQTLTLTCTFSGFSLSTAGMSVGWIRQPPGKALEWLADIWWDDKKHYNPSLKDRLTISKDTSKNQVVLKVTNMDPADTATYYCARDMIFNWYFDVWGQGTTVTVSS

SEQ ID NO: 378 - protein, 197 aa, Artificial Sequence
  A16b4 VL chain
DRVTITCLLSSRVGYMHWYQQKPGKAPKLLIYDTMYQASGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 379 - protein, 106 aa, Artificial Sequence
  A16b4 VL domain
DIQMTQSPSTLSASVGDRVTITCLLSSRVGYMHWYQQKPGKAPKLLIYDTMYQASGVPSRFSGSGSGTEFTLTISSLQPDDFATYYCFQGSGYPFTFGGGTKVEIK

SEQ ID NO: 380 - protein, 10 aa, Artificial Sequence
  A16b4 VL CDR1
LLSSRVGYMH

SEQ ID NO: 381 - protein, 7 aa, Artificial Sequence
  A16b4 VL CDR2
DTMYQAS

SEQ ID NO: 382 - protein, 450 aa, Artificial Sequence; identical to SEQ ID NO: 376
  A17b5 VH chain

SEQ ID NO: 383 - protein, 120 aa, Artificial Sequence; identical to SEQ ID NO: 377
  A17b5 VH domain

SEQ ID NO: 384 - protein, 213 aa, Artificial Sequence
  A17b5 VL chain
DIQMTQSPSTLSASVGDRVTITCSLSSRVGYMHWYQQKPGKAPKLLIYDTYYLPSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 385 - protein, 106 aa, Artificial Sequence
  A17b5 VL domain
DIQMTQSPSTLSASVGDRVTITCSLSSRVGYMHWYQQKPGKAPKLLIYDTYYLPSGVPSRFSGSGSGTEFTLTISSLQPDDFATYYCFQGSGYPFTFGGGTKVEIK

SEQ ID NO: 386 - protein, 7 aa, Artificial Sequence
  A17b5 VLCDR2
DTYYLPS

SEQ ID NO: 387 - protein, 450 aa, Artificial Sequence
  A17f5 VH chain
QVTLRESGPALVKPTQTLTLTCTFSGFSLSTAGMSVGWIRQPPGKALEWLADIWWDDKKDYNPSLKDRLTISKDTSKNQVVLKVTNMDPADTATYYCARDMIFNWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 388 - protein, 120 aa, Artificial Sequence
  A17f5 VH domain
QVTLRESGPALVKPTQTLTLTCTFSGFSLSTAGMSVGWIRQPPGKALEWLADIWWDDKKDYNPSLKDRLTISKDTSKNQVVLKVTNMDPADTATYYCARDMIFNWYFDVWGQGTTVTVSS

SEQ ID NO: 389 - protein, 16 aa, Artificial Sequence
  A17f5 VH CDR2
DIWWDDKKDYNPSLKD

SEQ ID NO: 390 - protein, 213 aa, Artificial Sequence
  A17f5 VL chain
DIQMTQSPSTLSASVGDRVTITCSLSSRVGYMHWYQQKPGKAPKLLIYDTFRHTSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 391 - protein, 106 aa, Artificial Sequence
  A17f5 VL domain
DIQMTQSPSTLSASVGDRVTITCSLSSRVGYMHWYQQKPGKAPKLLIYDTFRHTSGVPSRFSGSGSGTEFTLTISSLQPDDFATYYCFQGSGYPFTFGGGTKVEIK

SEQ ID NO: 392 - protein, 7 aa, Artificial Sequence
  A17f5 VL CDR2
DTFRHTS

SEQ ID NO: 393 - protein, 213 aa, Artificial Sequence
  A17h4 VL chain
DIQMTQSPSTLSASVGDRVTITCSPSSSVGYMHWYQQKPGKAPKLLIYDTYYLASGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 394 - protein, 106 aa, Artificial Sequence
  A17h4 VL domain
DIQMTQSPSTLSASVGDRVTITCSPSSSVGYMHWYQQKPGKAPKLLIYDTYYLASGVPSRFSGSGSGTEFTLTISSLQPDDFATYYCFQGSGYPFTFGGGTKVEIK

SEQ ID NO: 395 - protein, 10 aa, Artificial Sequence
  A17h4 VL CDR1
SPSSSVGYMH

SEQ ID NO: 396 - protein, 7 aa, Artificial Sequence
  A17h4 VL CDR2
DTYYLAS

SEQ ID NO: 397 - protein, 16 aa, Artificial Sequence
  VH CDR2
DIWWDDKGDYNPSLKS

SEQ ID NO: 398 - protein, 16 aa, Artificial Sequence
  VH CDR2
DIWWDDKGDYNPSLKD

SEQ ID NO: 399 - protein, 16 aa, Artificial Sequence
  VH CDR2
DIWWDDKGHYNPSLKS

SEQ ID NO: 400 - protein, 16 aa, Artificial Sequence
  VH CDR2
DIWWDDKGHYNPSLKD

SEQ ID NO: 401 - protein, 16 aa, Artificial Sequence
  VH CDR2
DIWWDDKGSYNPSLKS

SEQ ID NO: 402 - protein, 16 aa, Artificial Sequence
  VH CDR2
DIWWDDKGSYNPSLKD

SEQ ID NO: 403 - protein, 16 aa, Artificial Sequence
  VH CDR2
DIWWDGKGDYNPSLKS

SEQ ID NO: 404 - protein, 16 aa, Artificial Sequence
  VH CDR2
DIWWDGKGDYNPSLKD

SEQ ID NO: 405 - protein, 16 aa, Artificial Sequence
  VH CDR2
DIWWDGKGHYNPSLKS

SEQ ID NO: 406 - protein, 16 aa, Artificial Sequence
  VH CDR2
DIWWDGKGHYNPSLKD

SEQ ID NO: 407 - protein, 16 aa, Artificial Sequence
  VH CDR2
DIWWDGKGSYNPSLKS

SEQ ID NO: 408 - protein, 16 aa, Artificial Sequence
  VH CDR2
DIWWDGKGSYNPSLKD

SEQ ID NO: 409 - protein, 10 aa, Artificial Sequence
  VL CDR1
KCQLFVGYMH

SEQ ID NO: 410 - protein, 10 aa, Artificial Sequence
  VL CDR1
KCQSFVGYMH

SEQ ID NO: 411 - protein, 10 aa, Artificial Sequence
  VL CDR1
KCQVSVGYMH

SEQ ID NO: 412 - protein, 10 aa, Artificial Sequence
  VL CDR1
KCQVRVGYMH

SEQ ID NO: 413 - protein, 10 aa, Artificial Sequence
  VL CDR1
KCQVFVGYMH

SEQ ID NO: 414 - protein, 10 aa, Artificial Sequence
  VL CDR1
KCSLFVGYMH

SEQ ID NO: 415 - protein, 10 aa, Artificial Sequence
  VL CDR1
KCSSFVGYMH

SEQ ID NO: 416 - protein, 10 aa, Artificial Sequence
  VL CDR1
KCSVSVGYMH

SEQ ID NO: 417 - protein, 10 aa, Artificial Sequence
  VL CDR1
KCSVRVGYMH

SEQ ID NO: 418 - protein, 10 aa, Artificial Sequence
  VL CDR1
KCSVFVGYMH

SEQ ID NO: 419 - protein, 10 aa, Artificial Sequence
  VL CDR1
KAQLFVGYMH

SEQ ID NO: 420 - protein, 10 aa, Artificial Sequence
  VL CDR1
SCQLFVGYMH

SEQ ID NO: 421 - protein, 10 aa, Artificial Sequence
  VL CDR1
SCQSFVGYMH

SEQ ID NO: 422 - protein, 10 aa, Artificial Sequence
  VL CDR1
SCQVSVGYMH

SEQ ID NO: 423 - protein, 10 aa, Artificial Sequence
  VL CDR1
SCQVRVGYMH

SEQ ID NO: 424 - protein, 10 aa, Artificial Sequence
  VL CDR1
SCQVFVGYMH

SEQ ID NO: 425 - protein, 10 aa, Artificial Sequence
  VL CDR1
SCSLFVGYMH

SEQ ID NO: 426 - protein, 10 aa, Artificial Sequence
  VL CDR1
SCSSFVGYMH

SEQ ID NO: 427 - protein, 10 aa, Artificial Sequence
  VL CDR1
SCSVSVGYMH

SEQ ID NO: 428 - protein, 10 aa, Artificial Sequence
  VL CDR1
SCSVRVGYMH

SEQ ID NO: 429 - protein, 10 aa, Artificial Sequence
  VL CDR1
SCSVFVGYMH

SEQ ID NO: 430 - protein, 10 aa, Artificial Sequence
  VL CDR1
SAQLFVGYMH

SEQ ID NO: 431 - protein, 10 aa, Artificial Sequence
  VL CDR1
LCQLFVGYMH

SEQ ID NO: 432 - protein, 10 aa, Artificial Sequence
  VL CDR1
LCQSFVGYMH

SEQ ID NO: 433 - protein, 10 aa, Artificial Sequence
  VL CDR1
LCQVSVGYMH

SEQ ID NO: 434 - protein, 10 aa, Artificial Sequence
  VL CDR1
LCQVRVGYMH

SEQ ID NO: 435 - protein, 10 aa, Artificial Sequence
  VL CDR1
LCQVFVGYMH

SEQ ID NO: 436 - protein, 10 aa, Artificial Sequence
  VL CDR1
LCSLFVGYMH

SEQ ID NO: 437 - protein, 10 aa, Artificial Sequence
  VL CDR1
LCSSFVGYMH

SEQ ID NO: 438 - protein, 10 aa, Artificial Sequence
  VL CDR1
LCSVSVGYMH

SEQ ID NO: 439 - protein, 10 aa, Artificial Sequence
  VL CDR1
LCSVRVGYMH

SEQ ID NO: 440 - protein, 10 aa, Artificial Sequence
  VL CDR1
LCSVFVGYMH

SEQ ID NO: 441 - protein, 10 aa, Artificial Sequence
  VL CDR1
LAQLSVGYMH

SEQ ID NO: 442 - protein, 10 aa, Artificial Sequence
  VL CDR1
LAQLRVGYMH

SEQ ID NO: 443 - protein, 10 aa, Artificial Sequence
  VL CDR1
LAQLFVGYMH

SEQ ID NO: 444 - protein, 10 aa, Artificial Sequence
  VL CDR1
LAQSSVGYMH

SEQ ID NO: 445 - protein, 10 aa, Artificial Sequence
  VL CDR1
KAQSFVGYMH

SEQ ID NO: 446 - protein, 10 aa, Artificial Sequence
  VL CDR1
KAQVSVGYMH

SEQ ID NO: 447 - protein, 10 aa, Artificial Sequence
  VL CDR1
KAQVRVGYMH

SEQ ID NO: 448 - protein, 10 aa, Artificial Sequence
  VL CDR1
KAQVFVGYMH

SEQ ID NO: 449 - protein, 10 aa, Artificial Sequence
  VL CDR1
KASLFVGYMH

SEQ ID NO: 450 - protein, 10 aa, Artificial Sequence
  VL CDR1
KASSFVGYMH

SEQ ID NO: 451 - protein, 10 aa, Artificial Sequence
  VL CDR1
KASVSVGYMH

SEQ ID NO: 452 - protein, 10 aa, Artificial Sequence
  VL CDR1
KASVRVGYMH

SEQ ID NO: 453 - protein, 10 aa, Artificial Sequence
  VL CDR1
KASVFVGYMH

SEQ ID NO: 454 - protein, 10 aa, Artificial Sequence
  VL CDR1
KLQLFVGYMH

SEQ ID NO: 455 - protein, 10 aa, Artificial Sequence
  VL CDR1
KLQSFVGYMH

SEQ ID NO: 456 - protein, 10 aa, Artificial Sequence
  VL CDR1
KLQVSVGYMH

SEQ ID NO: 457 - protein, 10 aa, Artificial Sequence
  VL CDR1
KLQVRVGYMH

SEQ ID NO: 458 - protein, 10 aa, Artificial Sequence
  VL CDR1
KLQVFVGYMH

SEQ ID NO: 459 - protein, 10 aa, Artificial Sequence
  VL CDR1
KLSLFVGYMH

SEQ ID NO: 460 - protein, 10 aa, Artificial Sequence
  VL CDR1
KLSSFVGYMH

SEQ ID NO: 461 - protein, 10 aa, Artificial Sequence
  VL CDR1
KLSVSVGYMH

SEQ ID NO: 462 - protein, 10 aa, Artificial Sequence
  VL CDR1
KLSVRVGYMH

SEQ ID NO: 463 - protein, 10 aa, Artificial Sequence
  VL CDR1
KLSVFVGYMH

SEQ ID NO: 464 - protein, 10 aa, Artificial Sequence
  VL CDR1
KPQLFVGYMH

SEQ ID NO: 465 - protein, 10 aa, Artificial Sequence
  VL CDR1
KPQSFVGYMH

SEQ ID NO: 466 - protein, 10 aa, Artificial Sequence
  VL CDR1
KPQVSVGYMH

SEQ ID NO: 467 - protein, 10 aa, Artificial Sequence
  VL CDR1
KPQVRVGYMH

SEQ ID NO: 468 - protein, 10 aa, Artificial Sequence
  VL CDR1
KPQVFVGYMH

SEQ ID NO: 469 - protein, 10 aa, Artificial Sequence
  VL CDR1
KPSLFVGYMH

SEQ ID NO: 470 - protein, 10 aa, Artificial Sequence
  VL CDR1
KPSSFVGYMH

SEQ ID NO: 471 - protein, 10 aa, Artificial Sequence
  VL CDR1
KPSVSVGYMH

SEQ ID NO: 472 - protein, 10 aa, Artificial Sequence
  VL CDR1
KPSVRVGYMH

SEQ ID NO: 473 - protein, 10 aa, Artificial Sequence
  VL CDR1
KPSVFVGYMH

SEQ ID NO: 474 - protein, 10 aa, Artificial Sequence
  VL CDR1
SAQSFVGYMH

SEQ ID NO: 475 - protein, 10 aa, Artificial Sequence
  VL CDR1
SAQVSVGYMH

SEQ ID NO: 476 - protein, 10 aa, Artificial Sequence
  VL CDR1
SAQVRVGYMH

SEQ ID NO: 477 - protein, 10 aa, Artificial Sequence
  VL CDR1
SAQVFVGYMH

SEQ ID NO: 478 - protein, 10 aa, Artificial Sequence
  VL CDR1
SASLFVGYMH

SEQ ID NO: 479 - protein, 10 aa, Artificial Sequence
  VL CDR1
SASSFVGYMH

SEQ ID NO: 480 - protein, 10 aa, Artificial Sequence
  VL CDR1
SASVSVGYMH

SEQ ID NO: 481 - protein, 10 aa, Artificial Sequence
  VL CDR1
SASVRVGYMH

SEQ ID NO: 482 - protein, 10 aa, Artificial Sequence
  VL CDR1
SASVFVGYMH

SEQ ID NO: 483 - protein, 10 aa, Artificial Sequence
  VL CDR1
SLQLFVGYMH

SEQ ID NO: 484 - protein, 10 aa, Artificial Sequence
  VL CDR1
SLQSFVGYMH

SEQ ID NO: 485 - protein, 10 aa, Artificial Sequence
  VL CDR1
SLQVSVGYMH

SEQ ID NO: 486 - protein, 10 aa, Artificial Sequence
  VL CDR1
SLQVRVGYMH

SEQ ID NO: 487 - protein, 10 aa, Artificial Sequence
  VL CDR1
SLQVFVGYMH

SEQ ID NO: 488 - protein, 10 aa, Artificial Sequence
  VL CDR1
SLSLFVGYMH

SEQ ID NO: 489 - protein, 10 aa, Artificial Sequence
  VL CDR1
SLSSFVGYMH

SEQ ID NO: 490 - protein, 10 aa, Artificial Sequence
  VL CDR1
SLSVSVGYMH

SEQ ID NO: 491 - protein, 10 aa, Artificial Sequence
  VL CDR1
SLSVRVGYMH

SEQ ID NO: 492 - protein, 10 aa, Artificial Sequence
  VL CDR1
SLSVFVGYMH

SEQ ID NO: 493 - protein, 10 aa, Artificial Sequence
  VL CDR1
SPQLFVGYMH

SEQ ID NO: 494 - protein, 10 aa, Artificial Sequence
  VL CDR1
SPQSFVGYMH

SEQ ID NO: 495 - protein, 10 aa, Artificial Sequence
  VL CDR1
SPQVSVGYMH

SEQ ID NO: 496 - protein, 10 aa, Artificial Sequence
  VL CDR1
SPQVRVGYMH

SEQ ID NO: 497 - protein, 10 aa, Artificial Sequence
  VL CDR1
SPQVFVGYMH

SEQ ID NO: 498 - protein, 10 aa, Artificial Sequence
  VL CDR1
SPSLFVGYMH

SEQ ID NO: 499 - protein, 10 aa, Artificial Sequence
  VL CDR1
SPSSFVGYMH

SEQ ID NO: 500 - protein, 10 aa, Artificial Sequence
  VL CDR1
SPSVSVGYMH

SEQ ID NO: 501 - protein, 10 aa, Artificial Sequence
  VL CDR1
SPSVRVGYMH

SEQ ID NO: 502 - protein, 10 aa, Artificial Sequence
  VL CDR1
SPSVFVGYMH

SEQ ID NO: 503 - protein, 10 aa, Artificial Sequence
  VL CDR1
LAQSRVGYMH

SEQ ID NO: 504 - protein, 10 aa, Artificial Sequence
  VL CDR1
LAQSFVGYMH

SEQ ID NO: 505 - protein, 10 aa, Artificial Sequence
  VL CDR1
LAQVSVGYMH

SEQ ID NO: 506 - protein, 10 aa, Artificial Sequence
  VL CDR1
LAQVRVGYMH

SEQ ID NO: 507 - protein, 10 aa, Artificial Sequence
  VL CDR1
LAQVFVGYMH

SEQ ID NO: 508 - protein, 10 aa, Artificial Sequence
  VL CDR1
LASLSVGYMH

SEQ ID NO: 509 - protein, 10 aa, Artificial Sequence
  VL CDR1
LASLRVGYMH

SEQ ID NO: 510 - protein, 10 aa, Artificial Sequence
  VL CDR1
LASLFVGYMH

SEQ ID NO: 511 - protein, 10 aa, Artificial Sequence
  VL CDR1
LASSSVGYMH

SEQ ID NO: 512 - protein, 10 aa, Artificial Sequence
  VL CDR1
LASSRVGYMH

SEQ ID NO: 513 - protein, 10 aa, Artificial Sequence
  VL CDR1
LASSFVGYMH

SEQ ID NO: 514 - protein, 10 aa, Artificial Sequence
  VL CDR1
LASVSVGYMH

SEQ ID NO: 515 - protein, 10 aa, Artificial Sequence
  VL CDR1
LASVRVGYMH

SEQ ID NO: 516 - protein, 10 aa, Artificial Sequence
  VL CDR1
LASVFVGYMH

SEQ ID NO: 517 - protein, 10 aa, Artificial Sequence
  VL CDR1
LLQLSVGYMH

SEQ ID NO: 518 - protein, 10 aa, Artificial Sequence
  VL CDR1
LLQLRVGYMH

SEQ ID NO: 519 - protein, 10 aa, Artificial Sequence
  VL CDR1
LLQLFVGYMH

SEQ ID NO: 520 - protein, 10 aa, Artificial Sequence
  VL CDR1
LLQSSVGYMH

SEQ ID NO: 521 - protein, 10 aa, Artificial Sequence
  VL CDR1
LLQSRVGYMH

SEQ ID NO: 522 - protein, 10 aa, Artificial Sequence
  VL CDR1
LLQSFVGYMH

SEQ ID NO: 523 - protein, 10 aa, Artificial Sequence
  VL CDR1
LLQVSVGYMH

SEQ ID NO: 524 - protein, 10 aa, Artificial Sequence
  VL CDR1
LLQVRVGYMH

SEQ ID NO: 525 - protein, 10 aa, Artificial Sequence
  VL CDR1
LLQVFVGYMH

SEQ ID NO: 526 - protein, 10 aa, Artificial Sequence
  VL CDR1
LLSLSVGYMH

SEQ ID NO: 527 - protein, 10 aa, Artificial Sequence
  VL CDR1
LLSLRVGYMH

SEQ ID NO: 528 - protein, 10 aa, Artificial Sequence
  VL CDR1
LLSLFVGYMH

SEQ ID NO: 529 - protein, 10 aa, Artificial Sequence
  VL CDR1
LLSSSVGYMH

SEQ ID NO: 530 - protein, 10 aa, Artificial Sequence
  VL CDR1
LLSSRVGYMH

SEQ ID NO: 531 - protein, 10 aa, Artificial Sequence
  VL CDR1
LLSSFVGYMH

SEQ ID NO: 532 - protein, 10 aa, Artificial Sequence
  VL CDR1
LLSVSVGYMH

SEQ ID NO: 533 - protein, 10 aa, Artificial Sequence
  VL CDR1
LLSVRVGYMH

SEQ ID NO: 534 - protein, 10 aa, Artificial Sequence
  VL CDR1
LLSVFVGYMH

SEQ ID NO: 535 - protein, 10 aa, Artificial Sequence
  VL CDR1
LPQLFVGYMH

SEQ ID NO: 536 - protein, 10 aa, Artificial Sequence
  VL CDR1
LPQSFVGYMH

SEQ ID NO: 537 - protein, 10 aa, Artificial Sequence
  VL CDR1
LPQVSVGYMH

SEQ ID NO: 538 - protein, 10 aa, Artificial Sequence
  VL CDR1
LPQVRVGYMH

SEQ ID NO: 539 - protein, 10 aa, Artificial Sequence
  VL CDR1
LPQVFVGYMH

SEQ ID NO: 540 - protein, 10 aa, Artificial Sequence
  VL CDR1
LPSLFVGYMH

SEQ ID NO: 541 - protein, 10 aa, Artificial Sequence
  VL CDR1
LPSSFVGYMH

SEQ ID NO: 542 - protein, 10 aa, Artificial Sequence
  VL CDR1
LPSVSVGYMH

SEQ ID NO: 543 - protein, 10 aa, Artificial Sequence
  VL CDR1
LPSVRVGYMH

SEQ ID NO: 544 - protein, 10 aa, Artificial Sequence
  VL CDR1
LPSVFVGYMH

SEQ ID NO: 545 - protein, 7 aa, Artificial Sequence
  VL CDR2
DTSKLKS

SEQ ID NO: 546 - protein, 7 aa, Artificial Sequence
  VL CDR2
DTSKLRS

SEQ ID NO: 547 - protein, 7 aa, Artificial Sequence
  VL CDR2
DTSKLHS

SEQ ID NO: 548 - protein, 7 aa, Artificial Sequence
  VL CDR2
DTFKLKS

SEQ ID NO: 549 - protein, 7 aa, Artificial Sequence
  VL CDR2
DTFKLRS

SEQ ID NO: 550 - protein, 7 aa, Artificial Sequence
  VL CDR2
DTFKLHS

SEQ ID NO: 551 - protein, 7 aa, Artificial Sequence
  VL CDR2
DTYKLAS

SEQ ID NO: 552 - protein, 7 aa, Artificial Sequence
  VL CDR2
DTYKLSS

SEQ ID NO: 553 - protein, 7 aa, Artificial Sequence
  VL CDR2
DTYKLKS

SEQ ID NO: 554 - protein, 7 aa, Artificial Sequence
  VL CDR2
DTYKLRS

SEQ ID NO: 555 - protein, 7 aa, Artificial Sequence
  VL CDR2
DTYKLHS

SEQ ID NO: 556 - protein, 7 aa, Artificial Sequence
  VL CDR2
DTRKLKS

SEQ ID NO: 557 - protein, 7 aa, Artificial Sequence
  VL CDR2
DTRKLRS

SEQ ID NO: 558 - protein, 7 aa, Artificial Sequence
  VL CDR2
DTRKLHS

SEQ ID NO: 559 - protein, 7 aa, Artificial Sequence
  VL CDR2
DTMKLKS

SEQ ID NO: 560 - protein, 7 aa, Artificial Sequence
  VL CDR2
DTMKLRS

SEQ ID NO: 561 - protein, 7 aa, Artificial Sequence
  VL CDR2
DTMKLHS

SEQ ID NO: 562 - protein, 7 aa, Artificial Sequence
  VL CDR2
DTKKLAS

SEQ ID NO: 563 - protein, 7 aa, Artificial Sequence
  VL CDR2
DTKKLSS

SEQ ID NO: 564 - protein, 7 aa, Artificial Sequence
  VL CDR2
DTKKLKS

SEQ ID NO: 565 - protein, 7 aa, Artificial Sequence
  VL CDR2
DTKKLRS

SEQ ID NO: 566 - protein, 7 aa, Artificial Sequence
  VL CDR2
DTKKLHS

SEQ ID NO: 567 - protein, 7 aa, Artificial Sequence
  VL CDR2
DTLKLSS

SEQ ID NO: 568 - protein, 7 aa, Artificial Sequence
  VL CDR2
DTLKLKS

SEQ ID NO: 569 - protein, 7 aa, Artificial Sequence
  VL CDR2
DTLKLRS

SEQ ID NO: 570 - protein, 7 aa, Artificial Sequence
  VL CDR2
DTLKLHS

SEQ ID NO: 571 - protein, 7 aa, Artificial Sequence
  VL CDR2
DTSKLTS

SEQ ID NO: 572 - protein, 7 aa, Artificial Sequence
  VL CDR2
DTSKHAS

SEQ ID NO: 573 - protein, 7 aa, Artificial Sequence
  VL CDR2
DTSKHSS

SEQ ID NO: 574 - protein, 7 aa, Artificial Sequence
  VL CDR2
DTSKHKS

SEQ ID NO: 575 - protein, 7 aa, Artificial Sequence
  VL CDR2
DTSKHRS

SEQ ID NO: 576 - protein, 7 aa, Artificial Sequence
  VL CDR2
DTSKHHS

SEQ ID NO: 577 - protein, 7 aa, Artificial Sequence
  VL CDR2
DTSKHPS

SEQ ID NO: 578 - protein, 7 aa, Artificial Sequence
  VL CDR2
DTSKHTS

SEQ ID NO: 579 - protein, 7 aa, Artificial Sequence
  VL CDR2
DTSKHDS

SEQ ID NO: 580 - protein, 7 aa, Artificial Sequence
  VL CDR2
DTSKQKS

SEQ ID NO: 581 - protein, 7 aa, Artificial Sequence
  VL CDR2
DTSKQRS

SEQ ID NO: 582 - protein, 7 aa, Artificial Sequence
  VL CDR2
DTSKQHS

SEQ ID NO: 583 - protein, 7 aa, Artificial Sequence
  VL CDR2
DTSKQPS

SEQ ID NO: 584 - protein, 7 aa, Artificial Sequence
  VL CDR2
DTSKQTS

SEQ ID NO: 585 - protein, 7 aa, Artificial Sequence
  VL CDR2
DTSKQDS

SEQ ID NO: 586 - protein, 7 aa, Artificial Sequence
  VL CDR2
DTSGLSS

SEQ ID NO: 587 - protein, 7 aa, Artificial Sequence
  VL CDR2
DTSGLKS

SEQ ID NO: 588 - protein, 7 aa, Artificial Sequence
  VL CDR2
DTSGLRS

SEQ ID NO: 589 - protein, 7 aa, Artificial Sequence
  VL CDR2
DTSGLHS

SEQ ID NO: 590 - protein, 7 aa, Artificial Sequence
  VL CDR2
DTSGLTS

SEQ ID NO: 591 - protein, 7 aa, Artificial Sequence
  VL CDR2
DTSGLDS

SEQ ID NO: 592 - protein, 7 aa, Artificial Sequence
  VL CDR2
DTSGHAS

SEQ ID NO: 593 - protein, 7 aa, Artificial Sequence
  VL CDR2
DTSGHSS

SEQ ID NO: 594 - protein, 7 aa, Artificial Sequence
  VL CDR2
DTSGHKS

SEQ ID NO: 595 - protein, 7 aa, Artificial Sequence
  VL CDR2
DTSGHRS

SEQ ID NO: 596 - protein, 7 aa, Artificial Sequence
  VL CDR2
DTSGHHS

SEQ ID NO: 597 - protein, 7 aa, Artificial Sequence
  VL CDR2
DTSGHPS

SEQ ID NO: 598 - protein, 7 aa, Artificial Sequence
  VL CDR2
DTSGHTS

SEQ ID NO: 599 - protein, 7 aa, Artificial Sequence
  VL CDR2
DTSGHDS

SEQ ID NO: 600 - protein, 7 aa, Artificial Sequence
  VL CDR2
DTSGQAS

SEQ ID NO: 601 - protein, 7 aa, Artificial Sequence
  VL CDR2
DTSGQSS

SEQ ID NO: 602 - protein, 7 aa, Artificial Sequence
  VL CDR2
DTFKLPS

SEQ ID NO: 603 - protein, 7 aa, Artificial Sequence
  VL CDR2
DTFKLTS

SEQ ID NO: 604 - protein, 7 aa, Artificial Sequence
  VL CDR2
DTFKLDS

SEQ ID NO: 605 - protein, 7 aa, Artificial Sequence
  VL CDR2
DTFKHAS

SEQ ID NO: 606 - protein, 7 aa, Artificial Sequence
  VL CDR2
DTFKHSS

SEQ ID NO: 607 - protein, 7 aa, Artificial Sequence
  VL CDR2
DTFKHKS

SEQ ID NO: 608 - protein, 7 aa, Artificial Sequence
  VL CDR2
DTFKHRS

SEQ ID NO: 609 - protein, 7 aa, Artificial Sequence
  VL CDR2
DTFKHHS

SEQ ID NO: 610 - protein, 7 aa, Artificial Sequence
  VL CDR2
DTFKHPS

SEQ ID NO: 611 - protein, 7 aa, Artificial Sequence
  VL CDR2
DTFKHTS

SEQ ID NO: 612 - protein, 7 aa, Artificial Sequence
  VL CDR2
DTFKHDS

SEQ ID NO: 613 - protein, 7 aa, Artificial Sequence
  VL CDR2
DTFKQAS

SEQ ID NO: 614 - protein, 7 aa, Artificial Sequence
  VL CDR2
DTFKQSS

SEQ ID NO: 615 - protein, 7 aa, Artificial Sequence
  VL CDR2
DTFKQKS

SEQ ID NO: 616 - protein, 7 aa, Artificial Sequence
  VL CDR2
DTFKQRS

SEQ ID NO: 617 - protein, 7 aa, Artificial Sequence
  VL CDR2
DTFKQHS

SEQ ID NO: 618 - protein, 7 aa, Artificial Sequence
  VL CDR2
DTFKQPS

SEQ ID NO: 619 - protein, 7 aa, Artificial Sequence
  VL CDR2
DTFKQTS

SEQ ID NO: 620 - protein, 7 aa, Artificial Sequence
  VL CDR2
DTFKQDS

SEQ ID NO: 621 - protein, 7 aa, Artificial Sequence
  VL CDR2
DTFGLAS

SEQ ID NO: 622 - protein, 7 aa, Artificial Sequence
  VL CDR2
DTFGLSS

SEQ ID NO: 623 - protein, 7 aa, Artificial Sequence
  VL CDR2
DTFGLKS

SEQ ID NO: 624 - protein, 7 aa, Artificial Sequence
  VL CDR2
DTFGLRS

SEQ ID NO: 625 - protein, 7 aa, Artificial Sequence
  VL CDR2
DTFGLHS

SEQ ID NO: 626 - protein, 7 aa, Artificial Sequence
  VL CDR2
DTFGLPS

SEQ ID NO: 627 - protein, 7 aa, Artificial Sequence
  VL CDR2
DTFGLTS

SEQ ID NO: 628 - protein, 7 aa, Artificial Sequence
  VL CDR2
DTFGLDS

SEQ ID NO: 629 - protein, 7 aa, Artificial Sequence
  VL CDR2
DTFGHAS

SEQ ID NO: 630 - protein, 7 aa, Artificial Sequence
  VL CDR2
DTFGHSS

SEQ ID NO: 631 - protein, 7 aa, Artificial Sequence
  VL CDR2
DTFGHKS

SEQ ID NO: 632 - protein, 7 aa, Artificial Sequence
  VL CDR2
DTFGHRS

SEQ ID NO: 633 - protein, 7 aa, Artificial Sequence
  VL CDR2
DTFGHHS

SEQ ID NO: 634 - protein, 7 aa, Artificial Sequence
  VL CDR2
DTFGHPS

SEQ ID NO: 635 - protein, 7 aa, Artificial Sequence
  VL CDR2
DTFGHTS

SEQ ID NO: 636 - protein, 7 aa, Artificial Sequence
  VL CDR2
DTFGHDS

SEQ ID NO: 637 - protein, 7 aa, Artificial Sequence
  VL CDR2
DTFGQAS

SEQ ID NO: 638 - protein, 7 aa, Artificial Sequence
  VL CDR2
DTFGQSS

SEQ ID NO: 639 - protein, 7 aa, Artificial Sequence
  VL CDR2
DTYKLPS

SEQ ID NO: 640 - protein, 7 aa, Artificial Sequence
  VL CDR2
DTYKLTS

SEQ ID NO: 641 - protein, 7 aa, Artificial Sequence
  VL CDR2
DTYKLDS

SEQ ID NO: 642 - protein, 7 aa, Artificial Sequence
  VL CDR2
DTYKHAS

SEQ ID NO: 643 - protein, 7 aa, Artificial Sequence
  VL CDR2
DTYKHSS

SEQ ID NO: 644 - protein, 7 aa, Artificial Sequence
  VL CDR2
DTYKHKS

SEQ ID NO: 645 - protein, 7 aa, Artificial Sequence
  VL CDR2
DTYKHRS

SEQ ID NO: 646 - protein, 7 aa, Artificial Sequence
  VL CDR2
DTYKHHS

SEQ ID NO: 647 - protein, 7 aa, Artificial Sequence
  VL CDR2
DTYKHPS

SEQ ID NO: 648 - protein, 7 aa, Artificial Sequence
  VL CDR2
DTYKHTS

SEQ ID NO: 649 - protein, 7 aa, Artificial Sequence
  VL CDR2
DTYKHDS

SEQ ID NO: 650 - protein, 7 aa, Artificial Sequence
  VL CDR2
DTYKQAS

SEQ ID NO: 651 - protein, 7 aa, Artificial Sequence
  VL CDR2
DTYKQSS

SEQ ID NO: 652 - protein, 7 aa, Artificial Sequence
  VL CDR2
DTYKQKS

SEQ ID NO: 653 - protein, 7 aa, Artificial Sequence
  VL CDR2
DTYKQRS

SEQ ID NO: 654 - protein, 7 aa, Artificial Sequence
  VL CDR2
DTYKQHS

SEQ ID NO: 655 - protein, 7 aa, Artificial Sequence
  VL CDR2
DTYKQPS

SEQ ID NO: 656 - protein, 7 aa, Artificial Sequence
  VL CDR2
DTYKQTS

SEQ ID NO: 657 - protein, 7 aa, Artificial Sequence
  VL CDR2
DTYKQDS

SEQ ID NO: 658 - protein, 7 aa, Artificial Sequence
  VL CDR2
DTYGLAS

SEQ ID NO: 659 - protein, 7 aa, Artificial Sequence
  VL CDR2
DTYGLSS

SEQ ID NO: 660 - protein, 7 aa, Artificial Sequence
  VL CDR2
DTYGLKS

SEQ ID NO: 661 - protein, 7 aa, Artificial Sequence
  VL CDR2
DTYGLRS

SEQ ID NO: 662 - protein, 7 aa, Artificial Sequence
  VL CDR2
DTYGLHS

SEQ ID NO: 663 - protein, 7 aa, Artificial Sequence
  VL CDR2
DTYGLPS

SEQ ID NO: 664 - protein, 7 aa, Artificial Sequence
  VL CDR2
DTYGLTS

SEQ ID NO: 665 - protein, 7 aa, Artificial Sequence
  VL CDR2
DTYGLDS

SEQ ID NO: 666 - protein, 7 aa, Artificial Sequence
  VL CDR2
DTYGHAS

SEQ ID NO: 667 - protein, 7 aa, Artificial Sequence
  VL CDR2
DTYGHSS

SEQ ID NO: 668 - protein, 7 aa, Artificial Sequence
  VL CDR2
DTYGHKS

SEQ ID NO: 669 - protein, 7 aa, Artificial Sequence
  VL CDR2
DTYGHRS

SEQ ID NO: 670 - protein, 7 aa, Artificial Sequence
  VL CDR2
DTYGHHS

SEQ ID NO: 671 - protein, 7 aa, Artificial Sequence
  VL CDR2
DTYGHPS

SEQ ID NO: 672 - protein, 7 aa, Artificial Sequence
  VL CDR2
DTYGHTS

SEQ ID NO: 673 - protein, 7 aa, Artificial Sequence
  VL CDR2
DTYGHDS

SEQ ID NO: 674 - protein, 7 aa, Artificial Sequence
  VL CDR2
DTYGQAS

SEQ ID NO: 675 - protein, 7 aa, Artificial Sequence
  VL CDR2
DTYGQSS

SEQ ID NO: 676 - protein, 7 aa, Artificial Sequence
  VL CDR2
DTRKLPS

SEQ ID NO: 677 - protein, 7 aa, Artificial Sequence
  VL CDR2
DTRKLTS

SEQ ID NO: 678 - protein, 7 aa, Artificial Sequence
  VL CDR2
DTRKLDS

SEQ ID NO: 679 - protein, 7 aa, Artificial Sequence
  VL CDR2
DTRKHAS

SEQ ID NO: 680 - protein, 7 aa, Artificial Sequence
  VL CDR2
DTRKHSS

SEQ ID NO: 681 - protein, 7 aa, Artificial Sequence
  VL CDR2
DTRKHKS

SEQ ID NO: 682 - protein, 7 aa, Artificial Sequence
  VL CDR2
DTRKHRS

SEQ ID NO: 683 - protein, 7 aa, Artificial Sequence
  VL CDR2
DTRKHHS

SEQ ID NO: 684 - protein, 7 aa, Artificial Sequence
  VL CDR2
DTRKHPS

SEQ ID NO: 685 - protein, 7 aa, Artificial Sequence
  VL CDR2
DTRKHTS

SEQ ID NO: 686 - protein, 7 aa, Artificial Sequence
  VL CDR2
DTRKHDS

SEQ ID NO: 687 - protein, 7 aa, Artificial Sequence
  VL CDR2
DTRKQKS

SEQ ID NO: 688 - protein, 7 aa, Artificial Sequence
  VL CDR2
DTRKQRS

SEQ ID NO: 689 - protein, 7 aa, Artificial Sequence
  VL CDR2
DTRKQHS

SEQ ID NO: 690 - protein, 7 aa, Artificial Sequence
  VL CDR2
DTRKQPS

SEQ ID NO: 691 - protein, 7 aa, Artificial Sequence
  VL CDR2
DTRKQTS

SEQ ID NO: 692 - protein, 7 aa, Artificial Sequence
  VL CDR2
DTRKQDS

SEQ ID NO: 693 - protein, 7 aa, Artificial Sequence
  VL CDR2
DTRGLSS

SEQ ID NO: 694 - protein, 7 aa, Artificial Sequence
  VL CDR2
DTRGLKS

SEQ ID NO: 695 - protein, 7 aa, Artificial Sequence
  VL CDR2
DTRGLRS

SEQ ID NO: 696 - protein, 7 aa, Artificial Sequence
  VL CDR2
DTRGLHS

SEQ ID NO: 697 - protein, 7 aa, Artificial Sequence
  VL CDR2
DTRGLTS

SEQ ID NO: 698 - protein, 7 aa, Artificial Sequence
  VL CDR2
DTRGLDS

SEQ ID NO: 699 - protein, 7 aa, Artificial Sequence
  VL CDR2
DTRGHAS

SEQ ID NO: 700 - protein, 7 aa, Artificial Sequence
  VL CDR2
DTRGHSS

SEQ ID NO: 701 - protein, 7 aa, Artificial Sequence
  VL CDR2
DTRGHKS

SEQ ID NO: 702 - protein, 7 aa, Artificial Sequence
  VL CDR2
DTRGHRS

SEQ ID NO: 703 - protein, 7 aa, Artificial Sequence
  VL CDR2
DTRGHHS

SEQ ID NO: 704 - protein, 7 aa, Artificial Sequence
  VL CDR2
DTRGHPS

SEQ ID NO: 705 - protein, 7 aa, Artificial Sequence
  VL CDR2
DTRGHTS

SEQ ID NO: 706 - protein, 7 aa, Artificial Sequence
  VL CDR2
DTRGHDS

SEQ ID NO: 707 - protein, 7 aa, Artificial Sequence
  VL CDR2
DTRGQAS

SEQ ID NO: 708 - protein, 7 aa, Artificial Sequence
  VL CDR2
DTRGQSS

SEQ ID NO: 709 - protein, 7 aa, Artificial Sequence
  VL CDR2
DTMKLPS

SEQ ID NO: 710 - protein, 7 aa, Artificial Sequence
  VL CDR2
DTMKLTS

SEQ ID NO: 711 - protein, 7 aa, Artificial Sequence
  VL CDR2
DTMKLDS

SEQ ID NO: 712 - protein, 7 aa, Artificial Sequence
  VL CDR2
DTMKHAS

SEQ ID NO: 713 - protein, 7 aa, Artificial Sequence
  VL CDR2
DTMKHSS

SEQ ID NO: 714 - protein, 7 aa, Artificial Sequence
  VL CDR2
DTMKHKS

SEQ ID NO: 715 - protein, 7 aa, Artificial Sequence
  VL CDR2
DTMKHRS

SEQ ID NO: 716 - protein, 7 aa, Artificial Sequence
  VL CDR2
DTMKHHS

SEQ ID NO: 717 - protein, 7 aa, Artificial Sequence
  VL CDR2
DTMKHPS

SEQ ID NO: 718 - protein, 7 aa, Artificial Sequence
  VL CDR2
DTMKHTS

SEQ ID NO: 719 - protein, 7 aa, Artificial Sequence
  VL CDR2
DTMKHDS

SEQ ID NO: 720 - protein, 7 aa, Artificial Sequence
  VL CDR2
DTMKQKS

SEQ ID NO: 721 - protein, 7 aa, Artificial Sequence
  VL CDR2
DTMKQRS

SEQ ID NO: 722 - protein, 7 aa, Artificial Sequence
  VL CDR2
DTMKQHS

SEQ ID NO: 723 - protein, 7 aa, Artificial Sequence
  VL CDR2
DTMKQPS

SEQ ID NO: 724 - protein, 7 aa, Artificial Sequence
  VL CDR2
DTMKQTS

SEQ ID NO: 725 - protein, 7 aa, Artificial Sequence
  VL CDR2
DTMKQDS

SEQ ID NO: 726 - protein, 7 aa, Artificial Sequence
  VL CDR2
DTMGLAS

SEQ ID NO: 727 - protein, 7 aa, Artificial Sequence
  VL CDR2
DTMGLSS

SEQ ID NO: 728 - protein, 7 aa, Artificial Sequence
  VL CDR2
DTMGLKS

SEQ ID NO: 729 - protein, 7 aa, Artificial Sequence
  VL CDR2
DTMGLRS

SEQ ID NO: 730 - protein, 7 aa, Artificial Sequence
  VL CDR2
DTMGLHS

SEQ ID NO: 731 - protein, 7 aa, Artificial Sequence
  VL CDR2
DTMGLPS

SEQ ID NO: 732 - protein, 7 aa, Artificial Sequence
  VL CDR2
DTMGLTS

SEQ ID NO: 733 - protein, 7 aa, Artificial Sequence
  VL CDR2
DTMGLDS

SEQ ID NO: 734 - protein, 7 aa, Artificial Sequence
  VL CDR2
DTMGHAS

SEQ ID NO: 735 - protein, 7 aa, Artificial Sequence
  VL CDR2
DTMGHSS

SEQ ID NO: 736 - protein, 7 aa, Artificial Sequence
  VL CDR2
DTMGHKS

SEQ ID NO: 737 - protein, 7 aa, Artificial Sequence
  VL CDR2
DTMGHRS

SEQ ID NO: 738 - protein, 7 aa, Artificial Sequence
  VL CDR2
DTMGHHS

SEQ ID NO: 739 - protein, 7 aa, Artificial Sequence
  VL CDR2
DTMGHPS

SEQ ID NO: 740 - protein, 7 aa, Artificial Sequence
  VL CDR2
DTMGHTS

SEQ ID NO: 741 - protein, 7 aa, Artificial Sequence
  VL CDR2
DTMGHDS

SEQ ID NO: 742 - protein, 7 aa, Artificial Sequence
  VL CDR2
DTMGQAS

SEQ ID NO: 743 - protein, 7 aa, Artificial Sequence
  VL CDR2
DTMGQSS

SEQ ID NO: 744 - protein, 7 aa, Artificial Sequence
  VL CDR2
DTKKLPS

SEQ ID NO: 745 - protein, 7 aa, Artificial Sequence
  VL CDR2
DTKKLTS

SEQ ID NO: 746 - protein, 7 aa, Artificial Sequence
  VL CDR2
DTKKLDS

SEQ ID NO: 747 - protein, 7 aa, Artificial Sequence
  VL CDR2
DTKKHAS

SEQ ID NO: 748 - protein, 7 aa, Artificial Sequence
  VL CDR2
DTKKHSS

SEQ ID NO: 749 - protein, 7 aa, Artificial Sequence
  VL CDR2
DTKKHKS

SEQ ID NO: 750 - protein, 7 aa, Artificial Sequence
  VL CDR2
DTKKHRS

SEQ ID NO: 751 - protein, 7 aa, Artificial Sequence
  VL CDR2
DTKKHHS

SEQ ID NO: 752 - protein, 7 aa, Artificial Sequence
  VL CDR2
DTKKHPS

SEQ ID NO: 753 - protein, 7 aa, Artificial Sequence
  VL CDR2
DTKKHTS

SEQ ID NO: 754 - protein, 7 aa, Artificial Sequence
  VL CDR2
DTKKHDS

SEQ ID NO: 755 - protein, 7 aa, Artificial Sequence
  VL CDR2
DTKKQAS

SEQ ID NO: 756 - protein, 7 aa, Artificial Sequence
  VL CDR2
DTKKQSS

SEQ ID NO: 757 - protein, 7 aa, Artificial Sequence
  VL CDR2
DTKKQKS

SEQ ID NO: 758 - protein, 7 aa, Artificial Sequence
  VL CDR2
DTKKQRS

SEQ ID NO: 759 - protein, 7 aa, Artificial Sequence
  VL CDR2
DTKKQHS

SEQ ID NO: 760 - protein, 7 aa, Artificial Sequence
  VL CDR2
DTKKQPS

SEQ ID NO: 761 - protein, 7 aa, Artificial Sequence
  VL CDR2
DTKKQTS

SEQ ID NO: 762 - protein, 7 aa, Artificial Sequence
  VL CDR2
DTKKQDS

SEQ ID NO: 763 - protein, 7 aa, Artificial Sequence
  VL CDR2
DTKGLAS

SEQ ID NO: 764 - protein, 7 aa, Artificial Sequence
  VL CDR2
DTKGLSS

SEQ ID NO: 765 - protein, 7 aa, Artificial Sequence
  VL CDR2
DTKGLKS

SEQ ID NO: 766 - protein, 7 aa, Artificial Sequence
  VL CDR2
DTKGLRS

SEQ ID NO: 767 - protein, 7 aa, Artificial Sequence
  VL CDR2
DTKGLHS

SEQ ID NO: 768 - protein, 7 aa, Artificial Sequence
  VL CDR2
DTKGLPS

SEQ ID NO: 769 - protein, 7 aa, Artificial Sequence
  VL CDR2
DTKGLTS

SEQ ID NO: 770 - protein, 7 aa, Artificial Sequence
  VL CDR2
DTKGLDS

SEQ ID NO: 771 - protein, 7 aa, Artificial Sequence
  VL CDR2
DTKGHAS

SEQ ID NO: 772 - protein, 7 aa, Artificial Sequence
  VL CDR2
DTKGHSS

SEQ ID NO: 773 - protein, 7 aa, Artificial Sequence
  VL CDR2
DTKGHKS

SEQ ID NO: 774 - protein, 7 aa, Artificial Sequence
  VL CDR2
DTKGHRS

SEQ ID NO: 775 - protein, 7 aa, Artificial Sequence
  VL CDR2
DTKGHHS

SEQ ID NO: 776 - protein, 7 aa, Artificial Sequence
  VL CDR2
DTKGHPS

SEQ ID NO: 777 - protein, 7 aa, Artificial Sequence
  VL CDR2
DTKGHTS

SEQ ID NO: 778 - protein, 7 aa, Artificial Sequence
  VL CDR2
DTKGHDS

SEQ ID NO: 779 - protein, 7 aa, Artificial Sequence
  VL CDR2
DTKGQAS

SEQ ID NO: 780 - protein, 7 aa, Artificial Sequence
  VL CDR2
DTKGQSS

SEQ ID NO: 781 - protein, 7 aa, Artificial Sequence
  VL CDR2
DTLKLPS

SEQ ID NO: 782 - protein, 7 aa, Artificial Sequence
  VL CDR2
DTLKLTS

SEQ ID NO: 783 - protein, 7 aa, Artificial Sequence
  VL CDR2
DTLKHAS

SEQ ID NO: 784 - protein, 7 aa, Artificial Sequence
  VL CDR2
DTLKHSS

SEQ ID NO: 785 - protein, 7 aa, Artificial Sequence
  VL CDR2
DTLKHKS

SEQ ID NO: 786 - protein, 7 aa, Artificial Sequence
  VL CDR2
DTLKHRS

SEQ ID NO: 787 - protein, 7 aa, Artificial Sequence
  VL CDR2
DTLKHHS

SEQ ID NO: 788 - protein, 7 aa, Artificial Sequence
  VL CDR2
DTLKHPS

SEQ ID NO: 789 - protein, 7 aa, Artificial Sequence
  VL CDR2
DTLKHTS

SEQ ID NO: 790 - protein, 7 aa, Artificial Sequence
  VL CDR2
DTLKHDS

SEQ ID NO: 791 - protein, 7 aa, Artificial Sequence
  VL CDR2
DTLKQAS

SEQ ID NO: 792 - protein, 7 aa, Artificial Sequence
  VL CDR2
DTLKQSS

SEQ ID NO: 793 - protein, 7 aa, Artificial Sequence
  VL CDR2
DTLKQKS

SEQ ID NO: 794 - protein, 7 aa, Artificial Sequence
  VL CDR2
DTLKQRS

SEQ ID NO: 795 - protein, 7 aa, Artificial Sequence
  VL CDR2
DTLKQHS

SEQ ID NO: 796 - protein, 7 aa, Artificial Sequence
  VL CDR2
DTLKQPS

SEQ ID NO: 797 - protein, 7 aa, Artificial Sequence
  VL CDR2
DTLKQTS

SEQ ID NO: 798 - protein, 7 aa, Artificial Sequence
  VL CDR2
DTLKQDS

SEQ ID NO: 799 - protein, 7 aa, Artificial Sequence
  VL CDR2
DTLGLAS

SEQ ID NO: 800 - protein, 7 aa, Artificial Sequence
  VL CDR2
DTLGLSS

SEQ ID NO: 801 - protein, 7 aa, Artificial Sequence
  VL CDR2
DTLGLKS

SEQ ID NO: 802 - protein, 7 aa, Artificial Sequence
  VL CDR2
DTLGLRS

SEQ ID NO: 803 - protein, 7 aa, Artificial Sequence
  VL CDR2
DTLGLHS

SEQ ID NO: 804 - protein, 7 aa, Artificial Sequence
  VL CDR2
DTLGLPS

SEQ ID NO: 805 - protein, 7 aa, Artificial Sequence
  VL CDR2
DTLGLTS

SEQ ID NO: 806 - protein, 7 aa, Artificial Sequence
  VL CDR2
DTLGLDS

SEQ ID NO: 807 - protein, 7 aa, Artificial Sequence
  VL CDR2
DTLGHAS

SEQ ID NO: 808 - protein, 7 aa, Artificial Sequence
  VL CDR2
DTLGHSS

SEQ ID NO: 809 - protein, 7 aa, Artificial Sequence
  VL CDR2
DTLGHKS

SEQ ID NO: 810 - protein, 7 aa, Artificial Sequence
  VL CDR2
DTLGHRS

SEQ ID NO: 811 - protein, 7 aa, Artificial Sequence
  VL CDR2
DTLGHHS

SEQ ID NO: 812 - protein, 7 aa, Artificial Sequence
  VL CDR2
DTLGHPS

SEQ ID NO: 813 - protein, 7 aa, Artificial Sequence
  VL CDR2
DTLGHTS

SEQ ID NO: 814 - protein, 7 aa, Artificial Sequence
  VL CDR2
DTLGHDS

SEQ ID NO: 815 - protein, 7 aa, Artificial Sequence
  VL CDR2
DTLGQAS

SEQ ID NO: 816 - protein, 7 aa, Artificial Sequence
  VL CDR2
DTLGQSS

SEQ ID NO: 817 - protein, 7 aa, Artificial Sequence
  VL CDR2
DTSGQKS

SEQ ID NO: 818 - protein, 7 aa, Artificial Sequence
  VL CDR2
DTSGQRS

SEQ ID NO: 819 - protein, 7 aa, Artificial Sequence
  VL CDR2
DTSGQHS

SEQ ID NO: 820 - protein, 7 aa, Artificial Sequence
  VL CDR2
DTSGQPS

SEQ ID NO: 821 - protein, 7 aa, Artificial Sequence
  VL CDR2
DTSGQTS

SEQ ID NO: 822 - protein, 7 aa, Artificial Sequence
  VL CDR2
DTSGQDS

SEQ ID NO: 823 - protein, 7 aa, Artificial Sequence
  VL CDR2
DTSRLSS

SEQ ID NO: 824 - protein, 7 aa, Artificial Sequence
  VL CDR2
DTSRLKS

SEQ ID NO: 825 - protein, 7 aa, Artificial Sequence
  VL CDR2
DTSRLRS

SEQ ID NO: 826 - protein, 7 aa, Artificial Sequence
  VL CDR2
DTSRLHS

SEQ ID NO: 827 - protein, 7 aa, Artificial Sequence
  VL CDR2
DTSRLPS

SEQ ID NO: 828 - protein, 7 aa, Artificial Sequence
  VL CDR2
DTSRLTS

SEQ ID NO: 829 - protein, 7 aa, Artificial Sequence
  VL CDR2
DTSRLDS

SEQ ID NO: 830 - protein, 7 aa, Artificial Sequence
  VL CDR2
DTSRHAS

SEQ ID NO: 831 - protein, 7 aa, Artificial Sequence
  VL CDR2
DTSRHSS

SEQ ID NO: 832 - protein, 7 aa, Artificial Sequence
  VL CDR2
DTSRHKS

SEQ ID NO: 833 - protein, 7 aa, Artificial Sequence
  VL CDR2
DTSRHRS

SEQ ID NO: 834 - protein, 7 aa, Artificial Sequence
  VL CDR2
DTSRHHS

SEQ ID NO: 835 - protein, 7 aa, Artificial Sequence
  VL CDR2
DTSRHPS

SEQ ID NO: 836 - protein, 7 aa, Artificial Sequence
  VL CDR2
DTSRHTS

SEQ ID NO: 837 - protein, 7 aa, Artificial Sequence
  VL CDR2
DTSRHDS

SEQ ID NO: 838 - protein, 7 aa, Artificial Sequence
  VL CDR2
DTSRQAS

SEQ ID NO: 839 - protein, 7 aa, Artificial Sequence
  VL CDR2
DTSRQSS

SEQ ID NO: 840 - protein, 7 aa, Artificial Sequence
  VL CDR2
DTSRQKS

SEQ ID NO: 841 - protein, 7 aa, Artificial Sequence
  VL CDR2
DTSRQRS

SEQ ID NO: 842 - protein, 7 aa, Artificial Sequence
  VL CDR2
DTSRQHS

SEQ ID NO: 843 - protein, 7 aa, Artificial Sequence
  VL CDR2
DTSRQPS

SEQ ID NO: 844 - protein, 7 aa, Artificial Sequence
  VL CDR2
DTSRQTS

SEQ ID NO: 845 - protein, 7 aa, Artificial Sequence
  VL CDR2
DTSRQDS

SEQ ID NO: 846 - protein, 7 aa, Artificial Sequence
  VL CDR2
DTSYLKS

SEQ ID NO: 847 - protein, 7 aa, Artificial Sequence
  VL CDR2
DTSYLRS

SEQ ID NO: 848 - protein, 7 aa, Artificial Sequence
  VL CDR2
DTSYLHS

SEQ ID NO: 849 - protein, 7 aa, Artificial Sequence
  VL CDR2
DTSYLPS

SEQ ID NO: 850 - protein, 7 aa, Artificial Sequence
  VL CDR2
DTFGQKS

SEQ ID NO: 851 - protein, 7 aa, Artificial Sequence
  VL CDR2
DTFGQRS

SEQ ID NO: 852 - protein, 7 aa, Artificial Sequence
  VL CDR2
DTFGQHS

SEQ ID NO: 853 - protein, 7 aa, Artificial Sequence
  VL CDR2
DTFGQPS

SEQ ID NO: 854 - protein, 7 aa, Artificial Sequence
  VL CDR2
DTFGQTS

SEQ ID NO: 855 - protein, 7 aa, Artificial Sequence
  VL CDR2
DTFGQDS

SEQ ID NO: 856 - protein, 7 aa, Artificial Sequence
  VL CDR2
DTFRLAS

SEQ ID NO: 857 - protein, 7 aa, Artificial Sequence
  VL CDR2
DTFRLSS

SEQ ID NO: 858 - protein, 7 aa, Artificial Sequence
  VL CDR2
DTFKLKS

SEQ ID NO: 859 - protein, 7 aa, Artificial Sequence
  VL CDR2
DTFRLRS

SEQ ID NO: 860 - protein, 7 aa, Artificial Sequence
  VL CDR2
DTFRLHS

SEQ ID NO: 861 - protein, 7 aa, Artificial Sequence
  VL CDR2
DTFRLPS

SEQ ID NO: 862 - protein, 7 aa, Artificial Sequence
  VL CDR2
DTFRLTS

SEQ ID NO: 863 - protein, 7 aa, Artificial Sequence
  VL CDR2
DTFRLDS

SEQ ID NO: 864 - protein, 7 aa, Artificial Sequence
  VL CDR2
DTFRHAS

SEQ ID NO: 865 - protein, 7 aa, Artificial Sequence
  VL CDR2
DTFRHSS

SEQ ID NO: 866 - protein, 7 aa, Artificial Sequence
  VL CDR2
DTFRHKS

SEQ ID NO: 867 - protein, 7 aa, Artificial Sequence
  VL CDR2
DTFRHRS

SEQ ID NO: 868 - protein, 7 aa, Artificial Sequence
  VL CDR2
DTFRHHS

SEQ ID NO: 869 - protein, 7 aa, Artificial Sequence
  VL CDR2
DTFRHPS

SEQ ID NO: 870 - protein, 7 aa, Artificial Sequence
  VL CDR2
DTFRHTS

SEQ ID NO: 871 - protein, 7 aa, Artificial Sequence
  VL CDR2
DTFRHDS

SEQ ID NO: 872 - protein, 7 aa, Artificial Sequence
  VL CDR2
DTFRQAS

SEQ ID NO: 873 - protein, 7 aa, Artificial Sequence
  VL CDR2
DTFRQSS

SEQ ID NO: 874 - protein, 7 aa, Artificial Sequence
  VL CDR2
DTFRQKS

SEQ ID NO: 875 - protein, 7 aa, Artificial Sequence
  VL CDR2
DTFRQRS

SEQ ID NO: 876 - protein, 7 aa, Artificial Sequence
  VL CDR2
DTFRQHS

SEQ ID NO: 877 - protein, 7 aa, Artificial Sequence
  VL CDR2
DTFRQPS

SEQ ID NO: 878 - protein, 7 aa, Artificial Sequence
  VL CDR2
DTFRQTS

SEQ ID NO: 879 - protein, 7 aa, Artificial Sequence
  VL CDR2
DTFRQDS

SEQ ID NO: 880 - protein, 7 aa, Artificial Sequence
  VL CDR2
DTFYLKS

SEQ ID NO: 881 - protein, 7 aa, Artificial Sequence
  VL CDR2
DTFYLRS

SEQ ID NO: 882 - protein, 7 aa, Artificial Sequence
  VL CDR2
DTFYLHS

SEQ ID NO: 883 - protein, 7 aa, Artificial Sequence
  VL CDR2
DTFYLPS

SEQ ID NO: 884 - protein, 7 aa, Artificial Sequence
  VL CDR2
DTYGQKS

SEQ ID NO: 885 - protein, 7 aa, Artificial Sequence
  VL CDR2
DTYGQRS

SEQ ID NO: 886 - protein, 7 aa, Artificial Sequence
  VL CDR2
DTYGQHS

SEQ ID NO: 887 - protein, 7 aa, Artificial Sequence
  VL CDR2
DTYGQPS

SEQ ID NO: 888 - protein, 7 aa, Artificial Sequence
  VL CDR2
DTYGQTS

SEQ ID NO: 889 - protein, 7 aa, Artificial Sequence
  VL CDR2
DTYGQDS

SEQ ID NO: 890 - protein, 7 aa, Artificial Sequence
  VL CDR2
DTYRLAS

SEQ ID NO: 891 - protein, 7 aa, Artificial Sequence
  VL CDR2
DTYRLSS

SEQ ID NO: 892 - protein, 7 aa, Artificial Sequence
  VL CDR2
DTYRLKS

SEQ ID NO: 893 - protein, 7 aa, Artificial Sequence
  VL CDR2
DTYRLRS

SEQ ID NO: 894 - protein, 7 aa, Artificial Sequence
  VL CDR2
DTYRLHS

SEQ ID NO: 895 - protein, 7 aa, Artificial Sequence
  VL CDR2
DTYRLPS

SEQ ID NO: 896 - protein, 7 aa, Artificial Sequence
  VL CDR2
DTYRLTS

SEQ ID NO: 897 - protein, 7 aa, Artificial Sequence
  VL CDR2
DTYRLDS

SEQ ID NO: 898 - protein, 7 aa, Artificial Sequence
  VL CDR2
DTYRHAS

SEQ ID NO: 899 - protein, 7 aa, Artificial Sequence
  VL CDR2
DTYRHSS

SEQ ID NO: 900 - protein, 7 aa, Artificial Sequence
  VL CDR2
DTYRHKS

SEQ ID NO: 901 - protein, 7 aa, Artificial Sequence
  VL CDR2
DTYRHRS

SEQ ID NO: 902 - protein, 7 aa, Artificial Sequence
  VL CDR2
DTYRHHS

SEQ ID NO: 903 - protein, 7 aa, Artificial Sequence
  VL CDR2
DTYRHPS

SEQ ID NO: 904 - protein, 7 aa, Artificial Sequence
  VL CDR2
DTYRHTS

SEQ ID NO: 905 - protein, 7 aa, Artificial Sequence
  VL CDR2
DTYRHDS

SEQ ID NO: 906 - protein, 7 aa, Artificial Sequence
  VL CDR2
DTYRQAS

SEQ ID NO: 907 - protein, 7 aa, Artificial Sequence
  VL CDR2
DTYRQSS

SEQ ID NO: 908 - protein, 7 aa, Artificial Sequence
  VL CDR2
DTYRQKS

SEQ ID NO: 909 - protein, 7 aa, Artificial Sequence
  VL CDR2
DTYRQRS

SEQ ID NO: 910 - protein, 7 aa, Artificial Sequence
  VL CDR2
DTYRQHS

SEQ ID NO: 911 - protein, 7 aa, Artificial Sequence
  VL CDR2
DTYRQPS

SEQ ID NO: 912 - protein, 7 aa, Artificial Sequence
  VL CDR2
DTYRQTS

SEQ ID NO: 913 - protein, 7 aa, Artificial Sequence
  VL CDR2
DTYRQDS

SEQ ID NO: 914 - protein, 7 aa, Artificial Sequence
  VL CDR2
DTYYLAS

SEQ ID NO: 915 - protein, 7 aa, Artificial Sequence
  VL CDR2
DTYYLSS

SEQ ID NO: 916 - protein, 7 aa, Artificial Sequence
  VL CDR2
DTYYLKS

SEQ ID NO: 917 - protein, 7 aa, Artificial Sequence
  VL CDR2
DTYYLRS

SEQ ID NO: 918 - protein, 7 aa, Artificial Sequence
  VL CDR2
DTYYLHS

SEQ ID NO: 919 - protein, 7 aa, Artificial Sequence
  VL CDR2
DTYYLPS

SEQ ID NO: 920 - protein, 7 aa, Artificial Sequence
  VL CDR2
DTRGQKS

SEQ ID NO: 921 - protein, 7 aa, Artificial Sequence
  VL CDR2
DTRGQRS

SEQ ID NO: 922 - protein, 7 aa, Artificial Sequence
  VL CDR2
DTRGQHS

SEQ ID NO: 923 - protein, 7 aa, Artificial Sequence
  VL CDR2
DTRGQPS

SEQ ID NO: 924 - protein, 7 aa, Artificial Sequence
  VL CDR2
DTRGQTS

SEQ ID NO: 925 - protein, 7 aa, Artificial Sequence
  VL CDR2
DTRGQDS

SEQ ID NO: 926 - protein, 7 aa, Artificial Sequence
  VL CDR2
DTRRLAS

SEQ ID NO: 927 - protein, 7 aa, Artificial Sequence
  VL CDR2
DTRRLSS

SEQ ID NO: 928 - protein, 7 aa, Artificial Sequence
  VL CDR2
DTRRLKS

SEQ ID NO: 929 - protein, 7 aa, Artificial Sequence
  VL CDR2
DTRRLRS

SEQ ID NO: 930 - protein, 7 aa, Artificial Sequence
  VL CDR2
DTRRLHS

SEQ ID NO: 931 - protein, 7 aa, Artificial Sequence
  VL CDR2
DTRRLPS

SEQ ID NO: 932 - protein, 7 aa, Artificial Sequence
  VL CDR2
DTRRLTS

SEQ ID NO: 933 - protein, 7 aa, Artificial Sequence
  VL CDR2
DTRRLDS

SEQ ID NO: 934 - protein, 7 aa, Artificial Sequence
  VL CDR2
DTRRHAS

SEQ ID NO: 935 - protein, 7 aa, Artificial Sequence
  VL CDR2
DTRRHSS

SEQ ID NO: 936 - protein, 7 aa, Artificial Sequence
  VL CDR2
DTRRHKS

SEQ ID NO: 937 - protein, 7 aa, Artificial Sequence
  VL CDR2
DTRRHRS

SEQ ID NO: 938 - protein, 7 aa, Artificial Sequence
  VL CDR2
DTRRHHS

SEQ ID NO: 939 - protein, 7 aa, Artificial Sequence
  VL CDR2
DTRRHPS

SEQ ID NO: 940 - protein, 7 aa, Artificial Sequence
  VL CDR2
DTRRHTS

SEQ ID NO: 941 - protein, 7 aa, Artificial Sequence
  VL CDR2
DTRRHDS

SEQ ID NO: 942 - protein, 7 aa, Artificial Sequence
  VL CDR2
DTRRQAS

SEQ ID NO: 943 - protein, 7 aa, Artificial Sequence
  VL CDR2
DTRRQSS

SEQ ID NO: 944 - protein, 7 aa, Artificial Sequence
  VL CDR2
DTRRQKS

SEQ ID NO: 945 - protein, 7 aa, Artificial Sequence
  VL CDR2
DTRRQRS

SEQ ID NO: 946 - protein, 7 aa, Artificial Sequence
  VL CDR2
DTRRQHS

SEQ ID NO: 947 - protein, 7 aa, Artificial Sequence
  VL CDR2
DTRRQPS

SEQ ID NO: 948 - protein, 7 aa, Artificial Sequence
  VL CDR2
DTRRQTS

SEQ ID NO: 949 - protein, 7 aa, Artificial Sequence
  VL CDR2
DTRRQDS

SEQ ID NO: 950 - protein, 7 aa, Artificial Sequence
  VL CDR2
DTRYLKS

SEQ ID NO: 951 - protein, 7 aa, Artificial Sequence
  VL CDR2
DTRYLRS

SEQ ID NO: 952 - protein, 7 aa, Artificial Sequence
  VL CDR2
DTRYLHS

SEQ ID NO: 953 - protein, 7 aa, Artificial Sequence
  VL CDR2
DTRYLPS

SEQ ID NO: 954 - protein, 7 aa, Artificial Sequence
  VL CDR2
DTMGQKS

SEQ ID NO: 955 - protein, 7 aa, Artificial Sequence
  VL CDR2
DTMGQRS

SEQ ID NO: 956 - protein, 7 aa, Artificial Sequence
  VL CDR2
DTMGQHS

SEQ ID NO: 957 - protein, 7 aa, Artificial Sequence
  VL CDR2
DTMGQPS

SEQ ID NO: 958 - protein, 7 aa, Artificial Sequence
  VL CDR2
DTMGQTS

SEQ ID NO: 959 - protein, 7 aa, Artificial Sequence
  VL CDR2
DTMGQDS

SEQ ID NO: 960 - protein, 7 aa, Artificial Sequence
  VL CDR2
DTMRLSS

SEQ ID NO: 961 - protein, 7 aa, Artificial Sequence
  VL CDR2
DTMRLKS

SEQ ID NO: 962 - protein, 7 aa, Artificial Sequence
  VL CDR2
DTMRLRS

SEQ ID NO: 963 - protein, 7 aa, Artificial Sequence
  VL CDR2
DTMRLHS

SEQ ID NO: 964 - protein, 7 aa, Artificial Sequence
  VL CDR2
DTMRLPS

SEQ ID NO: 965 - protein, 7 aa, Artificial Sequence
  VL CDR2
DTMRLTS

SEQ ID NO: 966 - protein, 7 aa, Artificial Sequence
  VL CDR2
DTMRLDS

SEQ ID NO: 967 - protein, 7 aa, Artificial Sequence
  VL CDR2
DTMRHAS

SEQ ID NO: 968 - protein, 7 aa, Artificial Sequence
  VL CDR2
DTMRHSS

SEQ ID NO: 969 - protein, 7 aa, Artificial Sequence
  VL CDR2
DTMRHKS

SEQ ID NO: 970 - protein, 7 aa, Artificial Sequence
  VL CDR2
DTMRHRS

SEQ ID NO: 971 - protein, 7 aa, Artificial Sequence
  VL CDR2
DTMRHHS

SEQ ID NO: 972 - protein, 7 aa, Artificial Sequence
  VL CDR2
DTMRHPS

SEQ ID NO: 973 - protein, 7 aa, Artificial Sequence
  VL CDR2
DTMRHTS

SEQ ID NO: 974 - protein, 7 aa, Artificial Sequence
  VL CDR2
DTMRHDS

SEQ ID NO: 975 - protein, 7 aa, Artificial Sequence
  VL CDR2
DTMRQAS

SEQ ID NO: 976 - protein, 7 aa, Artificial Sequence
  VL CDR2
DTMRQSS

SEQ ID NO: 977 - protein, 7 aa, Artificial Sequence
  VL CDR2
DTMRQKS

SEQ ID NO: 978 - protein, 7 aa, Artificial Sequence
  VL CDR2
DTMRQRS

SEQ ID NO: 979 - protein, 7 aa, Artificial Sequence
  VL CDR2
DTMRQHS

SEQ ID NO: 980 - protein, 7 aa, Artificial Sequence
  VL CDR2
DTMRQPS

SEQ ID NO: 981 - protein, 7 aa, Artificial Sequence
  VL CDR2
DTMRQTS

SEQ ID NO: 982 - protein, 7 aa, Artificial Sequence
  VL CDR2
DTMRQDS

SEQ ID NO: 983 - protein, 7 aa, Artificial Sequence
  VL CDR2
DTMYLKS

SEQ ID NO: 984 - protein, 7 aa, Artificial Sequence
  VL CDR2
DTMYLRS

SEQ ID NO: 985 - protein, 7 aa, Artificial Sequence
  VL CDR2
DTMYLHS

SEQ ID NO: 986 - protein, 7 aa, Artificial Sequence
  VL CDR2
DTMYLPS

SEQ ID NO: 987 - protein, 7 aa, Artificial Sequence
  VL CDR2
DTKGQKS

SEQ ID NO: 988 - protein, 7 aa, Artificial Sequence
  VL CDR2
DTKGQRS

SEQ ID NO: 989 - protein, 7 aa, Artificial Sequence
  VL CDR2
DTKGQHS

SEQ ID NO: 990 - protein, 7 aa, Artificial Sequence
  VL CDR2
DTKGQPS

SEQ ID NO: 991 - protein, 7 aa, Artificial Sequence
  VL CDR2
DTKGQTS

SEQ ID NO: 992 - protein, 7 aa, Artificial Sequence
  VL CDR2
DTKGQDS

SEQ ID NO: 993 - protein, 7 aa, Artificial Sequence
  VL CDR2
DTKRLAS

SEQ ID NO: 994 - protein, 7 aa, Artificial Sequence
  VL CDR2
DTKRLSS

SEQ ID NO: 995 - protein, 7 aa, Artificial Sequence
  VL CDR2
DTKRLKS

SEQ ID NO: 996 - protein, 7 aa, Artificial Sequence
  VL CDR2
DTKRLRS

SEQ ID NO: 997 - protein, 7 aa, Artificial Sequence
  VL CDR2
DTKRLHS

SEQ ID NO: 998 - protein, 7 aa, Artificial Sequence
  VL CDR2
DTKRLPS

SEQ ID NO: 999 - protein, 7 aa, Artificial Sequence
  VL CDR2
DTKRLTS

SEQ ID NO: 1000 - protein, 7 aa, Artificial Sequence
  VL CDR2
DKTRLDS

SEQ ID NO: 1001 - protein, 7 aa, Artificial Sequence
  VL CDR2
DTKRHAS

SEQ ID NO: 1002 - protein, 7 aa, Artificial Sequence
  VL CDR2
DTKRHSS

SEQ ID NO: 1003 - protein, 7 aa, Artificial Sequence
  VL CDR2
DTKRHKS

SEQ ID NO: 1004 - protein, 7 aa, Artificial Sequence
  VL CDR2
DTKRHRS

SEQ ID NO: 1005 - protein, 7 aa, Artificial Sequence
  VL CDR2
DTKRHHS

SEQ ID NO: 1006 - protein, 7 aa, Artificial Sequence
  VL CDR2
DTKRHPS

SEQ ID NO: 1007 - protein, 7 aa, Artificial Sequence
  VL CDR2
DTKRHTS

SEQ ID NO: 1008 - protein, 7 aa, Artificial Sequence
  VL CDR2
DTKRHDS

SEQ ID NO: 1009 - protein, 7 aa, Artificial Sequence
  VL CDR2
DTKRQAS

SEQ ID NO: 1010 - protein, 7 aa, Artificial Sequence
  VL CDR2
DTRKQSS

SEQ ID NO: 1011 - protein, 7 aa, Artificial Sequence
  VL CDR2
DTKRQKS

SEQ ID NO: 1012 - protein, 7 aa, Artificial Sequence
  VL CDR2
DTKRQRS

SEQ ID NO: 1013 - protein, 7 aa, Artificial Sequence
  VL CDR2
DTKRQHS

SEQ ID NO: 1014 - protein, 7 aa, Artificial Sequence
  VL CDR2
DTKRQPS

SEQ ID NO: 1015 - protein, 7 aa, Artificial Sequence
  VL CDR2
DTKRQTS

SEQ ID NO: 1016 - protein, 7 aa, Artificial Sequence
  VL CDR2
DTKRQDS

SEQ ID NO: 1017 - protein, 7 aa, Artificial Sequence
  VL CDR2
DTKYLAS

SEQ ID NO: 1018 - protein, 7 aa, Artificial Sequence
  VL CDR2
DTKYLSS

SEQ ID NO: 1019 - protein, 7 aa, Artificial Sequence
  VL CDR2
DTKYLKS

SEQ ID NO: 1020 - protein, 7 aa, Artificial Sequence
  VL CDR2
DTKYLRS

SEQ ID NO: 1021 - protein, 7 aa, Artificial Sequence
  VL CDR2
DTKYLHS

SEQ ID NO: 1022 - protein, 7 aa, Artificial Sequence
  VL CDR2
DTKYLPS

SEQ ID NO: 1023 - protein, 7 aa, Artificial Sequence
  VL CDR2
DTLGQKS

SEQ ID NO: 1024 - protein, 7 aa, Artificial Sequence
  VL CDR2
DTLGQRS

SEQ ID NO: 1025 - protein, 7 aa, Artificial Sequence
  VL CDR2
DTLGQHS

SEQ ID NO: 1026 - protein, 7 aa, Artificial Sequence
  VL CDR2
DTLGQPS

SEQ ID NO: 1027 - protein, 7 aa, Artificial Sequence
  VL CDR2
DTLGQTS

SEQ ID NO: 1028 - protein, 7 aa, Artificial Sequence
  VL CDR2
DTLGQDS

SEQ ID NO: 1029 - protein, 7 aa, Artificial Sequence
  VL CDR2
DTLRLAS

SEQ ID NO: 1030 - protein, 7 aa, Artificial Sequence
  VL CDR2
DTLRLSS

SEQ ID NO: 1031 - protein, 7 aa, Artificial Sequence
  VL CDR2
DTLRLKS

SEQ ID NO: 1032 - protein, 7 aa, Artificial Sequence
  VL CDR2
DTLRLRS

SEQ ID NO: 1033 - protein, 7 aa, Artificial Sequence
  VL CDR2
DTLRLHS

SEQ ID NO: 1034 - protein, 7 aa, Artificial Sequence
  VL CDR2
DTLRLPS

SEQ ID NO: 1035 - protein, 7 aa, Artificial Sequence
  VL CDR2
DTLRLTS

SEQ ID NO: 1036 - protein, 7 aa, Artificial Sequence
  VL CDR2
DTLRLDS

SEQ ID NO: 1037 - protein, 7 aa, Artificial Sequence
  VL CDR2
DTLRHAS

SEQ ID NO: 1038 - protein, 7 aa, Artificial Sequence
  VL CDR2
DTLRHSS

SEQ ID NO: 1039 - protein, 7 aa, Artificial Sequence
  VL CDR2
DTLRHKS

SEQ ID NO: 1040 - protein, 7 aa, Artificial Sequence
  VL CDR2
DTLRHRS

SEQ ID NO: 1041 - protein, 7 aa, Artificial Sequence
  VL CDR2
DTLRHHS

SEQ ID NO: 1042 - protein, 7 aa, Artificial Sequence
  VL CDR2
DTLRHPS

SEQ ID NO: 1043 - protein, 7 aa, Artificial Sequence
  VL CDR2
DTLRHTS

SEQ ID NO: 1044 - protein, 7 aa, Artificial Sequence
  VL CDR2
DTLRHDS

SEQ ID NO: 1045 - protein, 7 aa, Artificial Sequence
  VL CDR2
DTLRQAS

SEQ ID NO: 1046 - protein, 7 aa, Artificial Sequence
  VL CDR2
DTLRQSS

SEQ ID NO: 1047 - protein, 7 aa, Artificial Sequence
  VL CDR2
DTLRQKS

SEQ ID NO: 1048 - protein, 7 aa, Artificial Sequence
  VL CDR2
DTLRQRS

SEQ ID NO: 1049 - protein, 7 aa, Artificial Sequence
  VL CDR2
DTLRQHS

SEQ ID NO: 1050 - protein, 7 aa, Artificial Sequence
  VL CDR2
DTLRQPS

SEQ ID NO: 1051 - protein, 7 aa, Artificial Sequence
  VL CDR2
DTLRQTS

SEQ ID NO: 1052 - protein, 7 aa, Artificial Sequence
  VL CDR2
DTLRQDS

SEQ ID NO: 1053 - protein, 7 aa, Artificial Sequence
  VL CDR2
DTLYLAS

SEQ ID NO: 1054 - protein, 7 aa, Artificial Sequence
  VL CDR2
DTLYLSS

SEQ ID NO: 1055 - protein, 7 aa, Artificial Sequence
  VL CDR2
DTLYLKS

SEQ ID NO: 1056 - protein, 7 aa, Artificial Sequence
  VL CDR2
DTLYLRS

SEQ ID NO: 1057 - protein, 7 aa, Artificial Sequence
  VL CDR2
DTLYLHS

SEQ ID NO: 1058 - protein, 7 aa, Artificial Sequence
  VL CDR2
DTLYLPS

SEQ ID NO: 1059 - protein, 7 aa, Artificial Sequence
  VL CDR2
DTSYLTS

SEQ ID NO: 1060 - protein, 7 aa, Artificial Sequence
  CDR L2
DTSYLDS

SEQ ID NO: 1061 - protein, 7 aa, Artificial Sequence
  CDR L2
DTSYHAS

SEQ ID NO: 1062 - protein, 7 aa, Artificial Sequence
  CDR L2
DTSYHSS

SEQ ID NO: 1063 - protein, 7 aa, Artificial Sequence
  CDR L2
DTSYHKS

SEQ ID NO: 1064 - protein, 7 aa, Artificial Sequence
  CDR L2
DTSYHRS

SEQ ID NO: 1065 - protein, 7 aa, Artificial Sequence
  CDR L2
DTSYHHS

SEQ ID NO: 1066 - protein, 7 aa, Artificial Sequence
  CDR L2
DTSYHPS

SEQ ID NO: 1067 - protein, 7 aa, Artificial Sequence
  CDR L2
DTSYHTS

SEQ ID NO: 1068 - protein, 7 aa, Artificial Sequence
  CDR L2
DTSYHDS

SEQ ID NO: 1069 - protein, 7 aa, Artificial Sequence
  CDR L2
DTSYQKS

SEQ ID NO: 1070 - protein, 7 aa, Artificial Sequence
  CDR L2
DTSYQRS

SEQ ID NO: 1071 - protein, 7 aa, Artificial Sequence
  CDR L2
DTSYQHS

SEQ ID NO: 1072 - protein, 7 aa, Artificial Sequence
  CDR L2
DTSYQPS

SEQ ID NO: 1073 - protein, 7 aa, Artificial Sequence
  CDR L2
DTSYQTS

SEQ ID NO: 1074 - protein, 7 aa, Artificial Sequence
  CDR L2
DTSYQDS

SEQ ID NO: 1075 - protein, 7 aa, Artificial Sequence
  CDR L2
DTSFLAS

SEQ ID NO: 1076 - protein, 7 aa, Artificial Sequence
  CDR L2
DTSFLSS

SEQ ID NO: 1077 - protein, 7 aa, Artificial Sequence
  CDR L2
DTSFLKS

SEQ ID NO: 1078 - protein, 7 aa, Artificial Sequence
  CDR L2
DTSFLRS

SEQ ID NO: 1079 - protein, 7 aa, Artificial Sequence
  CDR L2
DTSFLHS

SEQ ID NO: 1080 - protein, 7 aa, Artificial Sequence
  CDR L2
DTSFLPS

SEQ ID NO: 1081 - protein, 7 aa, Artificial Sequence
  CDR L2
DTSFLTS

SEQ ID NO: 1082 - protein, 7 aa, Artificial Sequence
  CDR L2
DTSFHAS

SEQ ID NO: 1083 - protein, 7 aa, Artificial Sequence
  CDR L2
DTSFHSS

SEQ ID NO: 1084 - protein, 7 aa, Artificial Sequence
  CDR L2
DTSFHKS

SEQ ID NO: 1085 - protein, 7 aa, Artificial Sequence
  CDR L2
DTSFHRS

SEQ ID NO: 1086 - protein, 7 aa, Artificial Sequence
  CDR L2
DTSFHHS

SEQ ID NO: 1087 - protein, 7 aa, Artificial Sequence
  CDR L2
DTSFHPS

SEQ ID NO: 1088 - protein, 7 aa, Artificial Sequence
  CDR L2
DTSFHTS

SEQ ID NO: 1089 - protein, 7 aa, Artificial Sequence
  CDR L2
DTSFHDS

SEQ ID NO: 1090 - protein, 7 aa, Artificial Sequence
  CDR L2
DTSFQAS

SEQ ID NO: 1091 - protein, 7 aa, Artificial Sequence
  CDR L2
DTSFQSS

SEQ ID NO: 1092 - protein, 7 aa, Artificial Sequence
  CDR L2
DTSFQKS

SEQ ID NO: 1093 - protein, 7 aa, Artificial Sequence
  CDR L2
DTFYLTS

SEQ ID NO: 1094 - protein, 7 aa, Artificial Sequence
  CDR L2
DTFYLDS

SEQ ID NO: 1095 - protein, 7 aa, Artificial Sequence
  CDR L2
DTFYHAS

SEQ ID NO: 1096 - protein, 7 aa, Artificial Sequence
  CDR L2
DTFYHSS

SEQ ID NO: 1097 - protein, 7 aa, Artificial Sequence
  CDR L2
DTFYHKS

SEQ ID NO: 1098 - protein, 7 aa, Artificial Sequence
  CDR L2
DTFYHRS

SEQ ID NO: 1099 - protein, 7 aa, Artificial Sequence
  CDR L2
DTFYHHS

SEQ ID NO: 1100 - protein, 7 aa, Artificial Sequence
  CDR L2
DTFYHPS

SEQ ID NO: 1101 - protein, 7 aa, Artificial Sequence
  CDR L2
DTFYHTS

SEQ ID NO: 1102 - protein, 7 aa, Artificial Sequence
  CDR L2
DTFYHDS

SEQ ID NO: 1103 - protein, 7 aa, Artificial Sequence
  CDR L2
DTFYQAS

SEQ ID NO: 1104 - protein, 7 aa, Artificial Sequence
  CDR L2
DTFYQSS

SEQ ID NO: 1105 - protein, 7 aa, Artificial Sequence
  CDR L2
DTFYQKS

SEQ ID NO: 1106 - protein, 7 aa, Artificial Sequence
  CDR L2
DTFYQRS

SEQ ID NO: 1107 - protein, 7 aa, Artificial Sequence
  CDR L2
DTFYQHS

SEQ ID NO: 1108 - protein, 7 aa, Artificial Sequence
  CDR L2
DTFYQPS

SEQ ID NO: 1109 - protein, 7 aa, Artificial Sequence
  CDR L2
DTFYQTS

SEQ ID NO: 1110 - protein, 7 aa, Artificial Sequence
  CDR L2
DTFYQDS

SEQ ID NO: 1111 - protein, 7 aa, Artificial Sequence
  CDR L2
DTFFLAS

SEQ ID NO: 1112 - protein, 7 aa, Artificial Sequence
  CDR L2
DTFFLSS

SEQ ID NO: 1113 - protein, 7 aa, Artificial Sequence
  CDR L2
DTFFLKS

SEQ ID NO: 1114 - protein, 7 aa, Artificial Sequence
  CDR L2
DTFFLRS

SEQ ID NO: 1115 - protein, 7 aa, Artificial Sequence
  CDR L2
DTFFLHS

SEQ ID NO: 1116 - protein, 7 aa, Artificial Sequence
  CDR L2
DTFFLPS

SEQ ID NO: 1117 - protein, 7 aa, Artificial Sequence
  CDR L2
DTFFLTS

SEQ ID NO: 1118 - protein, 7 aa, Artificial Sequence
  CDR L2
DTFFHAS

SEQ ID NO: 1119 - protein, 7 aa, Artificial Sequence
  CDR L2
DTFFHSS

SEQ ID NO: 1120 - protein, 7 aa, Artificial Sequence
  CDR L2
DTFFHKS

SEQ ID NO: 1121 - protein, 7 aa, Artificial Sequence
  CDR L2
DTFFHRS

SEQ ID NO: 1122 - protein, 7 aa, Artificial Sequence
  CDR L2
DTFFHHS

SEQ ID NO: 1123 - protein, 7 aa, Artificial Sequence
  CDR L2
DTFFHPS

SEQ ID NO: 1124 - protein, 7 aa, Artificial Sequence
  CDR L2
DTFFHTS

SEQ ID NO: 1125 - protein, 7 aa, Artificial Sequence
  CDR L2
DTFFHDS

SEQ ID NO: 1126 - protein, 7 aa, Artificial Sequence
  CDR L2
DTFFQAS

SEQ ID NO: 1127 - protein, 7 aa, Artificial Sequence
  CDR L2
DTFFQSS

SEQ ID NO: 1128 - protein, 7 aa, Artificial Sequence
  CDR L2
DTFFQKS

SEQ ID NO: 1129 - protein, 7 aa, Artificial Sequence
  CDR L2
DTYYLTS

SEQ ID NO: 1130 - protein, 7 aa, Artificial Sequence
  CDR L2
DTYYLDS

SEQ ID NO: 1131 - protein, 7 aa, Artificial Sequence
  CDR L2
DTYYHAS

SEQ ID NO: 1132 - protein, 7 aa, Artificial Sequence
  CDR L2
DTYYHSS

SEQ ID NO: 1133 - protein, 7 aa, Artificial Sequence
  CDR L2
DTYYHKS

SEQ ID NO: 1134 - protein, 7 aa, Artificial Sequence
  CDR L2
DTYYHRS

SEQ ID NO: 1135 - protein, 7 aa, Artificial Sequence
  CDR L2
DTYYHHS

SEQ ID NO: 1136 - protein, 7 aa, Artificial Sequence
  CDR L2
DTYYHPS

SEQ ID NO: 1137 - protein, 7 aa, Artificial Sequence
  CDR L2
DTYYHTS

SEQ ID NO: 1138 - protein, 7 aa, Artificial Sequence
  CDR L2
DTYYHDS

SEQ ID NO: 1139 - protein, 7 aa, Artificial Sequence
  VL CDR2
DTYYQAS

SEQ ID NO: 1140 - protein, 7 aa, Artificial Sequence
  VL CDR2
DTYYQSS

SEQ ID NO: 1141 - protein, 7 aa, Artificial Sequence
  VL CDR2
DTYYQKS

SEQ ID NO: 1142 - protein, 7 aa, Artificial Sequence
  VL CDR2
DTYYQRS

SEQ ID NO: 1143 - protein, 7 aa, Artificial Sequence
  VL CDR2
DTYYQHS

SEQ ID NO: 1144 - protein, 7 aa, Artificial Sequence
  VL CDR2
DTYYQPS

SEQ ID NO: 1145 - protein, 7 aa, Artificial Sequence
  VL CDR2
DTYYQTS

SEQ ID NO: 1146 - protein, 7 aa, Artificial Sequence
  VL CDR2
DTYYQDS

SEQ ID NO: 1147 - protein, 7 aa, Artificial Sequence
  VL CDR2
DTYFLAS

SEQ ID NO: 1148 - protein, 7 aa, Artificial Sequence
  VL CDR2
DTYFLSS

SEQ ID NO: 1149 - protein, 7 aa, Artificial Sequence
  VL CDR2
DTYFLKS

SEQ ID NO: 1150 - protein, 7 aa, Artificial Sequence
  VL CDR2
DTYFLRS

SEQ ID NO: 1151 - protein, 7 aa, Artificial Sequence
  VL CDR2
DTYFLHS

SEQ ID NO: 1152 - protein, 7 aa, Artificial Sequence
  VL CDR2
DTYFLPS

SEQ ID NO: 1153 - protein, 7 aa, Artificial Sequence
  VL CDR2
DTYFLTS

SEQ ID NO: 1154 - protein, 7 aa, Artificial Sequence
  VL CDR2
DTYFLDS

SEQ ID NO: 1155 - protein, 7 aa, Artificial Sequence
  VL CDR2
DTYFHAS

SEQ ID NO: 1156 - protein, 7 aa, Artificial Sequence
  VL CDR2
DTYFHSS

SEQ ID NO: 1157 - protein, 7 aa, Artificial Sequence
  VL CDR2
DTYFHKS

SEQ ID NO: 1158 - protein, 7 aa, Artificial Sequence
  VL CDR2
DTYFHRS

SEQ ID NO: 1159 - protein, 7 aa, Artificial Sequence
  VL CDR2
DTYFHHS

SEQ ID NO: 1160 - protein, 7 aa, Artificial Sequence
  VL CDR2
DTYFHPS

SEQ ID NO: 1161 - protein, 7 aa, Artificial Sequence
  VL CDR2
DTYFHTS

SEQ ID NO: 1162 - protein, 7 aa, Artificial Sequence
  VL CDR2
DTYFHDS

SEQ ID NO: 1163 - protein, 7 aa, Artificial Sequence
  VL CDR2
DTYFQAS

SEQ ID NO: 1164 - protein, 7 aa, Artificial Sequence
  VL CDR2
DTYFQSS

SEQ ID NO: 1165 - protein, 7 aa, Artificial Sequence
  VL CDR2
DTYFQKS

SEQ ID NO: 1166 - protein, 7 aa, Artificial Sequence
  VL CDR2
DTRYLTS

SEQ ID NO: 1167 - protein, 7 aa, Artificial Sequence
  VL CDR2
DTRYLDS

SEQ ID NO: 1168 - protein, 7 aa, Artificial Sequence
  VL CDR2
DTRYHAS

SEQ ID NO: 1169 - protein, 7 aa, Artificial Sequence
  VL CDR2
DTRYHSS

SEQ ID NO: 1170 - protein, 7 aa, Artificial Sequence
  VL CDR2
DTRYHKS

SEQ ID NO: 1171 - protein, 7 aa, Artificial Sequence
  VL CDR2
DTRYHRS

SEQ ID NO: 1172 - protein, 7 aa, Artificial Sequence
  VL CDR2
DTRYHHS

SEQ ID NO: 1173 - protein, 7 aa, Artificial Sequence
  VL CDR2
DTRYHPS

SEQ ID NO: 1174 - protein, 7 aa, Artificial Sequence
  VL CDR2
DTRYHTS

SEQ ID NO: 1175 - protein, 7 aa, Artificial Sequence
  VL CDR2
DTRYHDS

SEQ ID NO: 1176 - protein, 7 aa, Artificial Sequence
  VL CDR2
DTRYQKS

SEQ ID NO: 1177 - protein, 7 aa, Artificial Sequence
  VL CDR2
DTRYQRS

SEQ ID NO: 1178 - protein, 7 aa, Artificial Sequence
  VL CDR2
DTRYQHS

SEQ ID NO: 1179 - protein, 7 aa, Artificial Sequence
  VL CDR2
DTRYQPS

SEQ ID NO: 1180 - protein, 7 aa, Artificial Sequence
  VL CDR2
DTRYQTS

SEQ ID NO: 1181 - protein, 7 aa, Artificial Sequence
  VL CDR2
DTRYQDS

SEQ ID NO: 1182 - protein, 7 aa, Artificial Sequence
  VL CDR2
DTRFLAS

SEQ ID NO: 1183 - protein, 7 aa, Artificial Sequence
  VL CDR2
DTRFLSS

SEQ ID NO: 1184 - protein, 7 aa, Artificial Sequence
  VL CDR2
DTRFLKS

SEQ ID NO: 1185 - protein, 7 aa, Artificial Sequence
  VL CDR2
DTRFLRS

SEQ ID NO: 1186 - protein, 7 aa, Artificial Sequence
  VL CDR2
DTRFLHS

SEQ ID NO: 1187 - protein, 7 aa, Artificial Sequence
  VL CDR2
DTRFLPS

SEQ ID NO: 1188 - protein, 7 aa, Artificial Sequence
  VL CDR2
DTRFLTS

SEQ ID NO: 1189 - protein, 7 aa, Artificial Sequence
  VL CDR2
DTRFLDS

SEQ ID NO: 1190 - protein, 7 aa, Artificial Sequence
  VL CDR2
DTRFHAS

SEQ ID NO: 1191 - protein, 7 aa, Artificial Sequence
  VL CDR2
DTRFHSS

SEQ ID NO: 1192 - protein, 7 aa, Artificial Sequence
  VL CDR2
DTRFHKS

SEQ ID NO: 1193 - protein, 7 aa, Artificial Sequence
  VL CDR2
DTRFHRS

SEQ ID NO: 1194 - protein, 7 aa, Artificial Sequence
  VL CDR2
DTRFHHS

SEQ ID NO: 1195 - protein, 7 aa, Artificial Sequence
  VL CDR2
DTRFHPS

SEQ ID NO: 1196 - protein, 7 aa, Artificial Sequence
  VL CDR2
DTRFHTS

SEQ ID NO: 1197 - protein, 7 aa, Artificial Sequence
  VL CDR2
DTRFHDS

SEQ ID NO: 1198 - protein, 7 aa, Artificial Sequence
  VL CDR2
DTRFQAS

SEQ ID NO: 1199 - protein, 7 aa, Artificial Sequence
  VL CDR2
DTRFQSS

SEQ ID NO: 1200 - protein, 7 aa, Artificial Sequence
  VL CDR2
DTRFQKS

SEQ ID NO: 1201 - protein, 7 aa, Artificial Sequence
  VL CDR2
DTMYLTS

SEQ ID NO: 1202 - protein, 7 aa, Artificial Sequence
  VL CDR2
DTMYLDS

SEQ ID NO: 1203 - protein, 7 aa, Artificial Sequence
  VL CDR2
DTMYHAS

SEQ ID NO: 1204 - protein, 7 aa, Artificial Sequence
  VL CDR2
DTMYHSS

SEQ ID NO: 1205 - protein, 7 aa, Artificial Sequence
  VL CDR2
DTMYHKS

SEQ ID NO: 1206 - protein, 7 aa, Artificial Sequence
  VL CDR2
DTMYHRS

SEQ ID NO: 1207 - protein, 7 aa, Artificial Sequence
  VL CDR2
DTMYHHS

SEQ ID NO: 1208 - protein, 7 aa, Artificial Sequence
  VL CDR2
DTMYHPS

SEQ ID NO: 1209 - protein, 7 aa, Artificial Sequence
  VL CDR2
DTMYHTS

SEQ ID NO: 1210 - protein, 7 aa, Artificial Sequence
  VL CDR2
DTMYHDS

SEQ ID NO: 1211 - protein, 7 aa, Artificial Sequence
  VL CDR2
DTMYQKS

SEQ ID NO: 1212 - protein, 7 aa, Artificial Sequence
  VL CDR2
DTMYQRS

SEQ ID NO: 1213 - protein, 7 aa, Artificial Sequence
  VL CDR2
DTMYQHS

SEQ ID NO: 1214 - protein, 7 aa, Artificial Sequence
  VL CDR2
DTMYQPS

SEQ ID NO: 1215 - protein, 7 aa, Artificial Sequence
  VL CDR2
DTMYQTS

SEQ ID NO: 1216 - protein, 7 aa, Artificial Sequence
  VL CDR2
DTMYQDS

SEQ ID NO: 1217 - protein, 7 aa, Artificial Sequence
  VL CDR2
DTMFLAS

SEQ ID NO: 1218 - protein, 7 aa, Artificial Sequence
  VL CDR2
DTMFLSS

SEQ ID NO: 1219 - protein, 7 aa, Artificial Sequence
  VL CDR2
DTMFLKS

SEQ ID NO: 1220 - protein, 7 aa, Artificial Sequence
  VL CDR2
DTMFLRS

SEQ ID NO: 1221 - protein, 7 aa, Artificial Sequence
  VL CDR2
DTMFLHS

SEQ ID NO: 1222 - protein, 7 aa, Artificial Sequence
  VL CDR2
DTMFLPS

SEQ ID NO: 1223 - protein, 7 aa, Artificial Sequence
  VL CDR2
DTMFLTS

SEQ ID NO: 1224 - protein, 7 aa, Artificial Sequence
  VL CDR2
DTMFLDS

SEQ ID NO: 1225 - protein, 7 aa, Artificial Sequence
  VL CDR2
DTMFHAS

SEQ ID NO: 1226 - protein, 7 aa, Artificial Sequence
  VL CDR2
DTMFHSS

SEQ ID NO: 1227 - protein, 7 aa, Artificial Sequence
  VL CDR2
DTMFHKS

SEQ ID NO: 1228 - protein, 7 aa, Artificial Sequence
  VL CDR2
DTMFHRS

SEQ ID NO: 1229 - protein, 7 aa, Artificial Sequence
  VL CDR2
DTMFHHS

SEQ ID NO: 1230 - protein, 7 aa, Artificial Sequence
  VL CDR2
DTMFHPS

SEQ ID NO: 1231 - protein, 7 aa, Artificial Sequence
  VL CDR2
DTMFHTS

SEQ ID NO: 1232 - protein, 7 aa, Artificial Sequence
  VL CDR2
DTMFHDS

SEQ ID NO: 1233 - protein, 7 aa, Artificial Sequence
  VL CDR2
DTMFQAS

SEQ ID NO: 1234 - protein, 7 aa, Artificial Sequence
  VL CDR2
DTMFQSS

SEQ ID NO: 1235 - protein, 7 aa, Artificial Sequence
  VL CDR2
DTMFQKS

SEQ ID NO: 1236 - protein, 7 aa, Artificial Sequence
  VL CDR2
DTKYLTS

SEQ ID NO: 1237 - protein, 7 aa, Artificial Sequence
  VL CDR2
DTKYLDS

SEQ ID NO: 1238 - protein, 7 aa, Artificial Sequence
  VL CDR2
DTKYHAS

SEQ ID NO: 1239 - protein, 7 aa, Artificial Sequence
  VL CDR2
DTKYHSS

SEQ ID NO: 1240 - protein, 7 aa, Artificial Sequence
  VL CDR2
DTKYHKS

SEQ ID NO: 1241 - protein, 7 aa, Artificial Sequence
  VL CDR2
DTKYHRS

SEQ ID NO: 1242 - protein, 7 aa, Artificial Sequence
  VL CDR2
DTKYHHS

SEQ ID NO: 1243 - protein, 7 aa, Artificial Sequence
  VL CDR2
DTKYHPS

SEQ ID NO: 1244 - protein, 7 aa, Artificial Sequence
  VL CDR2
DTKYHTS

SEQ ID NO: 1245 - protein, 7 aa, Artificial Sequence
  VL CDR2
DTKYHDS

SEQ ID NO: 1246 - protein, 7 aa, Artificial Sequence
  VL CDR2
DTKYQAS

SEQ ID NO: 1247 - protein, 7 aa, Artificial Sequence
  VL CDR2
DTKYQSS

SEQ ID NO: 1248 - protein, 7 aa, Artificial Sequence
  VL CDR2
DTKYQKS

SEQ ID NO: 1249 - protein, 7 aa, Artificial Sequence
  VL CDR2
DTKYQRS

SEQ ID NO: 1250 - protein, 7 aa, Artificial Sequence
  VL CDR2
DTKYQHS

SEQ ID NO: 1251 - protein, 7 aa, Artificial Sequence
  VL CDR2
DTKYQPS

SEQ ID NO: 1252 - protein, 7 aa, Artificial Sequence
  VL CDR2
DTKYQTS

SEQ ID NO: 1253 - protein, 7 aa, Artificial Sequence
  VL CDR2
DTKYQDS

SEQ ID NO: 1254 - protein, 7 aa, Artificial Sequence
  VL CDR2
DTKFLAS

SEQ ID NO: 1255 - protein, 7 aa, Artificial Sequence
  VL CDR2
DTKFLSS

SEQ ID NO: 1256 - protein, 7 aa, Artificial Sequence
  VL CDR2
DTKFLKS

SEQ ID NO: 1257 - protein, 7 aa, Artificial Sequence
  VL CDR2
DTKFLRS

SEQ ID NO: 1258 - protein, 7 aa, Artificial Sequence
  VL CDR2
DTKFLHS

SEQ ID NO: 1259 - protein, 7 aa, Artificial Sequence
  VL CDR2
DTKFLPS

SEQ ID NO: 1260 - protein, 7 aa, Artificial Sequence
  VL CDR2
DTKFLTS

SEQ ID NO: 1261 - protein, 7 aa, Artificial Sequence
  VL CDR2
DTKFLDS

SEQ ID NO: 1262 - protein, 7 aa, Artificial Sequence
  VL CDR2
DTKFHAS

SEQ ID NO: 1263 - protein, 7 aa, Artificial Sequence
  VL CDR2
DTKFHSS

SEQ ID NO: 1264 - protein, 7 aa, Artificial Sequence
  VL CDR2
DTKFHKS

SEQ ID NO: 1265 - protein, 7 aa, Artificial Sequence
  VL CDR2
DTKFHRS

SEQ ID NO: 1266 - protein, 7 aa, Artificial Sequence
  VL CDR2
DTKFHHS

SEQ ID NO: 1267 - protein, 7 aa, Artificial Sequence
  VL CDR2
DTKFHPS

SEQ ID NO: 1268 - protein, 7 aa, Artificial Sequence
  VL CDR2
DTKFHTS

SEQ ID NO: 1269 - protein, 7 aa, Artificial Sequence
  VL CDR2
DTKFHDS

SEQ ID NO: 1270 - protein, 7 aa, Artificial Sequence
  VL CDR2
DTKFQAS

SEQ ID NO: 1271 - protein, 7 aa, Artificial Sequence
  VL CDR2
DTKFQSS

SEQ ID NO: 1272 - protein, 7 aa, Artificial Sequence
  VL CDR2
DTKFQKS

SEQ ID NO: 1273 - protein, 7 aa, Artificial Sequence
  VL CDR2
DTLYLTS

SEQ ID NO: 1274 - protein, 7 aa, Artificial Sequence
  VL CDR2
DTLYLDS

SEQ ID NO: 1275 - protein, 7 aa, Artificial Sequence
  VL CDR2
DTLYHAS

SEQ ID NO: 1276 - protein, 7 aa, Artificial Sequence
  VL CDR2
DTLYHSS

SEQ ID NO: 1277 - protein, 7 aa, Artificial Sequence
  VL CDR2
DTLYHKS

SEQ ID NO: 1278 - protein, 7 aa, Artificial Sequence
  VL CDR2
DTLYHRS

SEQ ID NO: 1279 - protein, 7 aa, Artificial Sequence
  VL CDR2
DTLYHHS

SEQ ID NO: 1280 - protein, 7 aa, Artificial Sequence
  VL CDR2
DTLYHPS

SEQ ID NO: 1281 - protein, 7 aa, Artificial Sequence
  VL CDR2
DTLYHTS

SEQ ID NO: 1282 - protein, 7 aa, Artificial Sequence
  VL CDR2
DTLYHDS

SEQ ID NO: 1283 - protein, 7 aa, Artificial Sequence
  VL CDR2
DTLYQAS

SEQ ID NO: 1284 - protein, 7 aa, Artificial Sequence
  VL CDR2
DTLYQSS

SEQ ID NO: 1285 - protein, 7 aa, Artificial Sequence
  VL CDR2
DTLYQKS

SEQ ID NO: 1286 - protein, 7 aa, Artificial Sequence
  VL CDR2
DTLYQRS

SEQ ID NO: 1287 - protein, 7 aa, Artificial Sequence
  VL CDR2
DTLYQHS

SEQ ID NO: 1288 - protein, 7 aa, Artificial Sequence
  VL CDR2
DTLYQPS

SEQ ID NO: 1289 - protein, 7 aa, Artificial Sequence
  VL CDR2
DTLYQTS

SEQ ID NO: 1290 - protein, 7 aa, Artificial Sequence
  VL CDR2
DTLYQDS

SEQ ID NO: 1291 - protein, 7 aa, Artificial Sequence
  VL CDR2
DTLFLAS

SEQ ID NO: 1292 - protein, 7 aa, Artificial Sequence
  VL CDR2
DTLFLSS

SEQ ID NO: 1293 - protein, 7 aa, Artificial Sequence
  VL CDR2
DTLFLKS

SEQ ID NO: 1294 - protein, 7 aa, Artificial Sequence
  VL CDR2
DTLFLRS

SEQ ID NO: 1295 - protein, 7 aa, Artificial Sequence
  VL CDR2
DTLFLHS

SEQ ID NO: 1296 - protein, 7 aa, Artificial Sequence
  VL CDR2
DTLFLPS

SEQ ID NO: 1297 - protein, 7 aa, Artificial Sequence
  VL CDR2
DTLFLTS

SEQ ID NO: 1298 - protein, 7 aa, Artificial Sequence
  VL CDR2
DTLFLDS

SEQ ID NO: 1299 - protein, 7 aa, Artificial Sequence
  VL CDR2
DTLFHAS

SEQ ID NO: 1300 - protein, 7 aa, Artificial Sequence
  VL CDR2
DTLFHSS

SEQ ID NO: 1301 - protein, 7 aa, Artificial Sequence
  VL CDR2
DTLFHKS

SEQ ID NO: 1302 - protein, 7 aa, Artificial Sequence
  VL CDR2
DTLFHRS

SEQ ID NO: 1303 - protein, 7 aa, Artificial Sequence
  VL CDR2
DTLFHHS

SEQ ID NO: 1304 - protein, 7 aa, Artificial Sequence
  VL CDR2
DTLFHPS

SEQ ID NO: 1305 - protein, 7 aa, Artificial Sequence
  VL CDR2
DTLFHTS

SEQ ID NO: 1306 - protein, 7 aa, Artificial Sequence
  VL CDR2
DTLFHDS

SEQ ID NO: 1307 - protein, 7 aa, Artificial Sequence
  VL CDR2
DTLFQAS

SEQ ID NO: 1308 - protein, 7 aa, Artificial Sequence
  VL CDR2
DTLFQSS

SEQ ID NO: 1309 - protein, 7 aa, Artificial Sequence
  VL CDR2
DTLFQKS

SEQ ID NO: 1310 - protein, 7 aa, Artificial Sequence
  VL CDR2
DTSFQRS

SEQ ID NO: 1311 - protein, 7 aa, Artificial Sequence
  VL CDR2
DTSFQHS

SEQ ID NO: 1312 - protein, 7 aa, Artificial Sequence
  VL CDR2
DTSFQPS

SEQ ID NO: 1313 - protein, 7 aa, Artificial Sequence
  VL CDR2
DTSFQTS

SEQ ID NO: 1314 - protein, 7 aa, Artificial Sequence
  VL CDR2
DTSFQDS

SEQ ID NO: 1315 - protein, 7 aa, Artificial Sequence
  VL CDR2
DTSLLSS

SEQ ID NO: 1316 - protein, 7 aa, Artificial Sequence
  VL CDR2
DTSLLKS

SEQ ID NO: 1317 - protein, 7 aa, Artificial Sequence
  VL CDR2
DTSLLRS

SEQ ID NO: 1318 - protein, 7 aa, Artificial Sequence
  VL CDR2
DTSLLHS

SEQ ID NO: 1319 - protein, 7 aa, Artificial Sequence
  VL CDR2
DTSLLPS

SEQ ID NO: 1320 - protein, 7 aa, Artificial Sequence
  VL CDR2
DTSLLTS

SEQ ID NO: 1321 - protein, 7 aa, Artificial Sequence
  VL CDR2
DTSLHAS

SEQ ID NO: 1322 - protein, 7 aa, Artificial Sequence
  VL CDR2
DTSLHSS

SEQ ID NO: 1323 - protein, 7 aa, Artificial Sequence
  VL CDR2
DTSLHKS

SEQ ID NO: 1324 - protein, 7 aa, Artificial Sequence
  VL CDR2
DTSLHRS

SEQ ID NO: 1325 - protein, 7 aa, Artificial Sequence
  VL CDR2
DTSLHHS

SEQ ID NO: 1326 - protein, 7 aa, Artificial Sequence
  VL CDR2
DTSLHPS

SEQ ID NO: 1327 - protein, 7 aa, Artificial Sequence
  VL CDR2
DTSLHTS

SEQ ID NO: 1328 - protein, 7 aa, Artificial Sequence
  VL CDR2
DTSLHDS

SEQ ID NO: 1329 - protein, 7 aa, Artificial Sequence
  VL CDR2
DTSLQAS

SEQ ID NO: 1330 - protein, 7 aa, Artificial Sequence
  VL CDR2
DTSLQSS

SEQ ID NO: 1331 - protein, 7 aa, Artificial Sequence
  VL CDR2
DTSLQKS

SEQ ID NO: 1332 - protein, 7 aa, Artificial Sequence
  VL CDR2
DTSLQRS

SEQ ID NO: 1333 - protein, 7 aa, Artificial Sequence
  VL CDR2
DTSLQHS

SEQ ID NO: 1334 - protein, 7 aa, Artificial Sequence
  VL CDR2
DTSLQPS

SEQ ID NO: 1335 - protein, 7 aa, Artificial Sequence
  VL CDR2
DTSLQTS

SEQ ID NO: 1336 - protein, 7 aa, Artificial Sequence
  VL CDR2
DTSLQDS

SEQ ID NO: 1337 - protein, 7 aa, Artificial Sequence
  VL CDR2
DTFFQRS

SEQ ID NO: 1338 - protein, 7 aa, Artificial Sequence
  VL CDR2
DTFFQHS

SEQ ID NO: 1339 - protein, 7 aa, Artificial Sequence
  VL CDR2
DTFFQPS

SEQ ID NO: 1340 - protein, 7 aa, Artificial Sequence
  VL CDR2
DTFFQTS

SEQ ID NO: 1341 - protein, 7 aa, Artificial Sequence
  VL CDR2
DTFFQDS

SEQ ID NO: 1342 - protein, 7 aa, Artificial Sequence
  VL CDR2
DTFLLAS

SEQ ID NO: 1343 - protein, 7 aa, Artificial Sequence
  VL CDR2
DTFLLSS

SEQ ID NO: 1344 - protein, 7 aa, Artificial Sequence
  VL CDR2
DTFLLKS

SEQ ID NO: 1345 - protein, 7 aa, Artificial Sequence
  VL CDR2
DTFLLRS

SEQ ID NO: 1346 - protein, 7 aa, Artificial Sequence
  VL CDR2
DTFLLHS

SEQ ID NO: 1347 - protein, 7 aa, Artificial Sequence
  VL CDR2
DTFLLPS

SEQ ID NO: 1348 - protein, 7 aa, Artificial Sequence
  VL CDR2
DTFLLTS

SEQ ID NO: 1349 - protein, 7 aa, Artificial Sequence
  VL CDR2
DTFLLDS

SEQ ID NO: 1350 - protein, 7 aa, Artificial Sequence
  VL CDR2
DTFLHAS

SEQ ID NO: 1351 - protein, 7 aa, Artificial Sequence
  VL CDR2
DTFLHSS

SEQ ID NO: 1352 - protein, 7 aa, Artificial Sequence
  VL CDR2
DTFLHKS

SEQ ID NO: 1353 - protein, 7 aa, Artificial Sequence
  VL CDR2
DTFLHRS

SEQ ID NO: 1354 - protein, 7 aa, Artificial Sequence
  VL CDR2
DTFLHHS

SEQ ID NO: 1355 - protein, 7 aa, Artificial Sequence
  VL CDR2
DTFLHPS

SEQ ID NO: 1356 - protein, 7 aa, Artificial Sequence
  VL CDR2
DTFLHTS

SEQ ID NO: 1357 - protein, 7 aa, Artificial Sequence
  VL CDR2
DTFLHDS

SEQ ID NO: 1358 - protein, 7 aa, Artificial Sequence
  VL CDR2
DTFLQAS

SEQ ID NO: 1359 - protein, 7 aa, Artificial Sequence
  VL CDR2
DTFLQSS

SEQ ID NO: 1360 - protein, 7 aa, Artificial Sequence
  VL CDR2
DTFLQKS

SEQ ID NO: 1361 - protein, 7 aa, Artificial Sequence
  VL CDR2
DTFLQRS

SEQ ID NO: 1362 - protein, 7 aa, Artificial Sequence
  VL CDR2
DTFLQHS

SEQ ID NO: 1363 - protein, 7 aa, Artificial Sequence
  VL CDR2
DTFLQPS

SEQ ID NO: 1364 - protein, 7 aa, Artificial Sequence
  VL CDR2
DTFLQTS

SEQ ID NO: 1365 - protein, 7 aa, Artificial Sequence
  VL CDR2
DTFLQDS

SEQ ID NO: 1366 - protein, 7 aa, Artificial Sequence
  VL CDR2
DTYFQRS

SEQ ID NO: 1367 - protein, 7 aa, Artificial Sequence
  VL CDR2
DTYFQHS

SEQ ID NO: 1368 - protein, 7 aa, Artificial Sequence
  VL CDR2
DTYFQPS

SEQ ID NO: 1369 - protein, 7 aa, Artificial Sequence
  VL CDR2
DTYFQTS

SEQ ID NO: 1370 - protein, 7 aa, Artificial Sequence
  VL CDR2
DTYFQDS

SEQ ID NO: 1371 - protein, 7 aa, Artificial Sequence
  VL CDR2
DTYLLAS

SEQ ID NO: 1372 - protein, 7 aa, Artificial Sequence
  VL CDR2
DTYLLSS

SEQ ID NO: 1373 - protein, 7 aa, Artificial Sequence
  VL CDR2
DTYLLKS

SEQ ID NO: 1374 - protein, 7 aa, Artificial Sequence
  VL CDR2
DTYLLRS

SEQ ID NO: 1375 - protein, 7 aa, Artificial Sequence
  VL CDR2
DTYLLHS

SEQ ID NO: 1376 - protein, 7 aa, Artificial Sequence
  VL CDR2
DTYLLPS

SEQ ID NO: 1377 - protein, 7 aa, Artificial Sequence
  VL CDR2
DTYLLTS

SEQ ID NO: 1378 - protein, 7 aa, Artificial Sequence
  VL CDR2
DTYLLDS

SEQ ID NO: 1379 - protein, 7 aa, Artificial Sequence
  VL CDR2
DTYLHAS

SEQ ID NO: 1380 - protein, 7 aa, Artificial Sequence
  VL CDR2
DTYLHSS

SEQ ID NO: 1381 - protein, 7 aa, Artificial Sequence
  VL CDR2
DTYLHKS

SEQ ID NO: 1382 - protein, 7 aa, Artificial Sequence
  VL CDR2
DTYLHRS

SEQ ID NO: 1383 - protein, 7 aa, Artificial Sequence
  VL CDR2
DTYLHHS

SEQ ID NO: 1384 - protein, 7 aa, Artificial Sequence
  VL CDR2
DTYLHPS

SEQ ID NO: 1385 - protein, 7 aa, Artificial Sequence
  VL CDR2
DTYLHTS

SEQ ID NO: 1386 - protein, 7 aa, Artificial Sequence
  VL CDR2
DTYLHDS

SEQ ID NO: 1387 - protein, 7 aa, Artificial Sequence
  VL CDR2
DTYLQAS

SEQ ID NO: 1388 - protein, 7 aa, Artificial Sequence
  VL CDR2
DTYLQSS

SEQ ID NO: 1389 - protein, 7 aa, Artificial Sequence
  VL CDR2
DTYLQKS

SEQ ID NO: 1390 - protein, 7 aa, Artificial Sequence
  VL CDR2
DTYLQRS

SEQ ID NO: 1391 - protein, 7 aa, Artificial Sequence
  VL CDR2
DTYLQHS

SEQ ID NO: 1392 - protein, 7 aa, Artificial Sequence
  VL CDR2
DTYLQPS

SEQ ID NO: 1393 - protein, 7 aa, Artificial Sequence
  VL CDR2
DTYLQTS

SEQ ID NO: 1394 - protein, 7 aa, Artificial Sequence
  VL CDR2
DTYLQDS

SEQ ID NO: 1395 - protein, 7 aa, Artificial Sequence
  VL CDR2
DTRFQRS

SEQ ID NO: 1396 - protein, 7 aa, Artificial Sequence
  VL CDR2
DTRFQHS

SEQ ID NO: 1397 - protein, 7 aa, Artificial Sequence
  VL CDR2
DTRFQPS

SEQ ID NO: 1398 - protein, 7 aa, Artificial Sequence
  VL CDR2
DTRFQTS

SEQ ID NO: 1399 - protein, 7 aa, Artificial Sequence
  VL CDR2
DTRFQDS

SEQ ID NO: 1400 - protein, 7 aa, Artificial Sequence
  VL CDR2
DTRLLAS

SEQ ID NO: 1401 - protein, 7 aa, Artificial Sequence
  VL CDR2
DTRLLSS

SEQ ID NO: 1402 - protein, 7 aa, Artificial Sequence
  VL CDR2
DTRLLKS

SEQ ID NO: 1403 - protein, 7 aa, Artificial Sequence
  VL CDR2
DTRLLRS

SEQ ID NO: 1404 - protein, 7 aa, Artificial Sequence
  VL CDR2
DTRLLHS

SEQ ID NO: 1405 - protein, 7 aa, Artificial Sequence
  VL CDR2
DTRLLPS

SEQ ID NO: 1406 - protein, 7 aa, Artificial Sequence
  VL CDR2
DTRLLTS

SEQ ID NO: 1407 - protein, 7 aa, Artificial Sequence
  VL CDR2
DTRLLDS

SEQ ID NO: 1408 - protein, 7 aa, Artificial Sequence
  VL CDR2
DTRLHAS

SEQ ID NO: 1409 - protein, 7 aa, Artificial Sequence
  VL CDR2
DTRLHSS

SEQ ID NO: 1410 - protein, 7 aa, Artificial Sequence
  VL CDR2
DTRLHKS

SEQ ID NO: 1411 - protein, 7 aa, Artificial Sequence
  VL CDR2
DTRLHRS

SEQ ID NO: 1412 - protein, 7 aa, Artificial Sequence
  VL CDR2
DTRLHHS

SEQ ID NO: 1413 - protein, 7 aa, Artificial Sequence
  VL CDR2
DTRLHPS

SEQ ID NO: 1414 - protein, 7 aa, Artificial Sequence
  VL CDR2
DTRLHTS

SEQ ID NO: 1415 - protein, 7 aa, Artificial Sequence
  VL CDR2
DTRLHDS

SEQ ID NO: 1416 - protein, 7 aa, Artificial Sequence
  VL CDR2
DTRLQAS

SEQ ID NO: 1417 - protein, 7 aa, Artificial Sequence
  VL CDR2
DTRLQSS

SEQ ID NO: 1418 - protein, 7 aa, Artificial Sequence
  VL CDR2
DTRLQKS

SEQ ID NO: 1419 - protein, 7 aa, Artificial Sequence
  VL CDR2
DTRLQRS

SEQ ID NO: 1420 - protein, 7 aa, Artificial Sequence
  VL CDR2
DTRLQHS

SEQ ID NO: 1421 - protein, 7 aa, Artificial Sequence
  VL CDR2
DTRLQPS

SEQ ID NO: 1422 - protein, 7 aa, Artificial Sequence
  VL CDR2
DTRLQTS

SEQ ID NO: 1423 - protein, 7 aa, Artificial Sequence
  VL CDR2
DTRLQDS

SEQ ID NO: 1424 - protein, 7 aa, Artificial Sequence
  VL CDR2
DTMFQRS

SEQ ID NO: 1425 - protein, 7 aa, Artificial Sequence
  VL CDR2
DTMFQHS

SEQ ID NO: 1426 - protein, 7 aa, Artificial Sequence
  VL CDR2
DTMFQPS

SEQ ID NO: 1427 - protein, 7 aa, Artificial Sequence
  VL CDR2
DTMFQTS

SEQ ID NO: 1428 - protein, 7 aa, Artificial Sequence
  VL CDR2
DTMFQDS

SEQ ID NO: 1429 - protein, 7 aa, Artificial Sequence
  VL CDR2
DTMLLAS

SEQ ID NO: 1430 - protein, 7 aa, Artificial Sequence
  VL CDR2
DTMLLSS

SEQ ID NO: 1431 - protein, 7 aa, Artificial Sequence
  VL CDR2
DTMLLKS

SEQ ID NO: 1432 - protein, 7 aa, Artificial Sequence
  VL CDR2
DTMLLRS

SEQ ID NO: 1433 - protein, 7 aa, Artificial Sequence
  VL CDR2
DTMLLHS

SEQ ID NO: 1434 - protein, 7 aa, Artificial Sequence
  VL CDR2
DTMLLPS

SEQ ID NO: 1435 - protein, 7 aa, Artificial Sequence
  VL CDR2
DTMLLTS

SEQ ID NO: 1436 - protein, 7 aa, Artificial Sequence
  VL CDR2
DTMLLDS

SEQ ID NO: 1437 - protein, 7 aa, Artificial Sequence
  VL CDR2
DTMLHAS

SEQ ID NO: 1438 - protein, 7 aa, Artificial Sequence
  VL CDR2
DTMLHSS

SEQ ID NO: 1439 - protein, 7 aa, Artificial Sequence
  VL CDR2
DTMLHKS

SEQ ID NO: 1440 - protein, 7 aa, Artificial Sequence
  VL CDR2
DTMLHRS

SEQ ID NO: 1441 - protein, 7 aa, Artificial Sequence
  VL CDR2
DTMLHHS

SEQ ID NO: 1442 - protein, 7 aa, Artificial Sequence
  VL CDR2
DTMLHPS

SEQ ID NO: 1443 - protein, 7 aa, Artificial Sequence
  VL CDR2
DTMLHTS

SEQ ID NO: 1444 - protein, 7 aa, Artificial Sequence
  VL CDR2
DTMLHDS

SEQ ID NO: 1445 - protein, 7 aa, Artificial Sequence
  VL CDR2
DTMLQAS

SEQ ID NO: 1446 - protein, 7 aa, Artificial Sequence
  VL CDR2
DTMLQSS

SEQ ID NO: 1447 - protein, 7 aa, Artificial Sequence
  VL CDR2
DTMLQKS

SEQ ID NO: 1448 - protein, 7 aa, Artificial Sequence
  VL CDR2
DTMLQRS

SEQ ID NO: 1449 - protein, 7 aa, Artificial Sequence
  VL CDR2
DTMLQHS

SEQ ID NO: 1450 - protein, 7 aa, Artificial Sequence
  VL CDR2
DTMLQPS

SEQ ID NO: 1451 - protein, 7 aa, Artificial Sequence
  VL CDR2
DTMLQTS

SEQ ID NO: 1452 - protein, 7 aa, Artificial Sequence
  VL CDR2
DTMLQDS

SEQ ID NO: 1453 - protein, 7 aa, Artificial Sequence
  VL CDR2
DTKFQRS

SEQ ID NO: 1454 - protein, 7 aa, Artificial Sequence
  VL CDR2
DTKFQHS

SEQ ID NO: 1455 - protein, 7 aa, Artificial Sequence
  VL CDR2
DTKFQPS

SEQ ID NO: 1456 - protein, 7 aa, Artificial Sequence
  VL CDR2
DTKFQTS

SEQ ID NO: 1457 - protein, 7 aa, Artificial Sequence
  VL CDR2
DTKFQDS

SEQ ID NO: 1458 - protein, 7 aa, Artificial Sequence
  VL CDR2
DTKLLAS

SEQ ID NO: 1459 - protein, 7 aa, Artificial Sequence
  VL CDR2
DTKLLSS

SEQ ID NO: 1460 - protein, 7 aa, Artificial Sequence
  VL CDR2
DTKLLKS

SEQ ID NO: 1461 - protein, 7 aa, Artificial Sequence
  VL CDR2
DTKLLRS

SEQ ID NO: 1462 - protein, 7 aa, Artificial Sequence
  VL CDR2
DTKLLHS

SEQ ID NO: 1463 - protein, 7 aa, Artificial Sequence
  VL CDR2
DTKLLPS

SEQ ID NO: 1464 - protein, 7 aa, Artificial Sequence
  VL CDR2
DTKLLTS

SEQ ID NO: 1465 - protein, 7 aa, Artificial Sequence
  VL CDR2
DTKLLDS

SEQ ID NO: 1466 - protein, 7 aa, Artificial Sequence
  VL CDR2
DTKLHAS

SEQ ID NO: 1467 - protein, 7 aa, Artificial Sequence
  VL CDR2
DTKLHSS

SEQ ID NO: 1468 - protein, 7 aa, Artificial Sequence
  VL CDR2
DTKLHKS

SEQ ID NO: 1469 - protein, 7 aa, Artificial Sequence
  VL CDR2
DTKLHRS

SEQ ID NO: 1470 - protein, 7 aa, Artificial Sequence
  VL CDR2
DTKLHHS

SEQ ID NO: 1471 - protein, 7 aa, Artificial Sequence
  VL CDR2
DTKLHPS

SEQ ID NO: 1472 - protein, 7 aa, Artificial Sequence
  VL CDR2
DTKLHTS

SEQ ID NO: 1473 - protein, 7 aa, Artificial Sequence
  VL CDR2
DTKLHDS

SEQ ID NO: 1474 - protein, 7 aa, Artificial Sequence
  VL CDR2
DTKLQAS

SEQ ID NO: 1475 - protein, 7 aa, Artificial Sequence
  VL CDR2
DTKLQSS

SEQ ID NO: 1476 - protein, 7 aa, Artificial Sequence
  VL CDR2
DTKLQKS

SEQ ID NO: 1477 - protein, 7 aa, Artificial Sequence
  VL CDR2
DTKLQRS

SEQ ID NO: 1478 - protein, 7 aa, Artificial Sequence
  VL CDR2
DTKLQHS

SEQ ID NO: 1479 - protein, 7 aa, Artificial Sequence
  VL CDR2
DTKLQPS

SEQ ID NO: 1480 - protein, 7 aa, Artificial Sequence
  VL CDR2
DTKLQTS

SEQ ID NO: 1481 - protein, 7 aa, Artificial Sequence
  VL CDR2
DTKLQDS

SEQ ID NO: 1482 - protein, 7 aa, Artificial Sequence
  VL CDR2
DTLFQRS

SEQ ID NO: 1483 - protein, 7 aa, Artificial Sequence
  VL CDR2
DTLFQHS

SEQ ID NO: 1484 - protein, 7 aa, Artificial Sequence
  VL CDR2
DTLFQPS

SEQ ID NO: 1485 - protein, 7 aa, Artificial Sequence
  VL CDR2
DTLFQTS

SEQ ID NO: 1486 - protein, 7 aa, Artificial Sequence
  VL CDR2
DTLFQDS

SEQ ID NO: 1487 - protein, 7 aa, Artificial Sequence
  VL CDR2
DTLLLAS

SEQ ID NO: 1488 - protein, 7 aa, Artificial Sequence
  VL CDR2
DTLLLSS

SEQ ID NO: 1489 - protein, 7 aa, Artificial Sequence
  VL CDR2
DTLLLKS

SEQ ID NO: 1490 - protein, 7 aa, Artificial Sequence
  VL CDR2
DTLLLRS

SEQ ID NO: 1491 - protein, 7 aa, Artificial Sequence
  VL CDR2
DTLLLHS

SEQ ID NO: 1492 - protein, 7 aa, Artificial Sequence
  VL CDR2
DTLLLPS

SEQ ID NO: 1493 - protein, 7 aa, Artificial Sequence
  VL CDR2
DTLLLTS

SEQ ID NO: 1494 - protein, 7 aa, Artificial Sequence
  VL CDR2
DTLLHAS

SEQ ID NO: 1495 - protein, 7 aa, Artificial Sequence
  VL CDR2
DTLLHSS

SEQ ID NO: 1496 - protein, 7 aa, Artificial Sequence
  VL CDR2
DTLLHKS

SEQ ID NO: 1497 - protein, 7 aa, Artificial Sequence
  VL CDR2
DTLLHRS

SEQ ID NO: 1498 - protein, 7 aa, Artificial Sequence
  VL CDR2
DTLLHHS

SEQ ID NO: 1499 - protein, 7 aa, Artificial Sequence
  VL CDR2
DTLLHPS

SEQ ID NO: 1500 - protein, 7 aa, Artificial Sequence
  VL CDR2
DTLLHTS

SEQ ID NO: 1501 - protein, 7 aa, Artificial Sequence
  VL CDR2
DTLLHDS

SEQ ID NO: 1502 - protein, 7 aa, Artificial Sequence
  VL CDR2
DTLLQAS

SEQ ID NO: 1503 - protein, 7 aa, Artificial Sequence
  VL CDR2
DTLLQSS

SEQ ID NO: 1504 - protein, 7 aa, Artificial Sequence
  VL CDR2
DTLLQKS

SEQ ID NO: 1505 - protein, 7 aa, Artificial Sequence
  VL CDR2
DTLLQRS

SEQ ID NO: 1506 - protein, 7 aa, Artificial Sequence
  VL CDR2
DTLLQHS

SEQ ID NO: 1507 - protein, 7 aa, Artificial Sequence
  VL CDR2
DTLLQPS

SEQ ID NO: 1508 - protein, 7 aa, Artificial Sequence
  VL CDR2
DTLLQTS

SEQ ID NO: 1509 - protein, 7 aa, Artificial Sequence
  VL CDR2
DTLLQDS

SEQ ID NO: 1510 - protein, 9 aa, Artificial Sequence
  VL CDR3
FQGSYYPFT

SEQ ID NO: 1511 - protein, 9 aa, Artificial Sequence
  VL CDR3
FQGSWYPFT

SEQ ID NO: 1512 - protein, 18 aa, Artificial Sequence
  Linker
GGSSRSSSSGGGGSGGGG

SEQ ID NO: 1513 - protein, 15 aa, Artificial Sequence
  Linker
GSGRSGGGGSGGGGS

SEQ ID NO: 1514 - protein, 14 aa, Artificial Sequence
  Linker
EGKSSGSGSESKST

SEQ ID NO: 1515 - protein, 15 aa, Artificial Sequence
  Linker
EGKSSGSGSESKSTQ

SEQ ID NO: 1516 - protein, 14 aa, Artificial Sequence
  Linker
EGKSSGSGSESKVD

SEQ ID NO: 1517 - protein, 14 aa, Artificial Sequence
  Linker
GSTSGSGKSSEGKG

SEQ ID NO: 1518 - protein, 18 aa, Artificial Sequence
  Linker
KESGSVSSEQLAQFRSLD

SEQ ID NO: 1519 - protein, 16 aa, Artificial Sequence
  Linker
ESGSVSSEELAFRSLD

SEQ ID NO: 1520 - protein, 298 aa, Human respiratory syncytial virus
MSKTKDQRTAKTLERTWDTLNHLLFISSCLYKLNLKSIAQITLSILAMIISTSLIIAAIIFIASANHKVTLTTAIIQDATNQIKNTTPTYLTQNPQLGISFSNLSETTSQPITILASTTPSAESTPQSTTVKTKNTTTTQIQPSKSTTKQRQNKPQNKPNNDFHFEVFNFVPCSICSNNPTCWAICKRIPNKKPGKKTTTKPTKKPTIKTTKKDLKPQTTKSKEVLTTKPTEKPTINTTKTNIRTTLLISNTTGNPEHTSQKETLHSTTSEGNPSPSQVYTTSEYLSQSLSPSNTTYY

SEQ ID NO: 1521 - protein, 2165 aa, Human respiratory syncytial virus
MDPIINGNSANVYLTDSYLKGVISFSECNALGSYIFNGPYLKNDYTNLISRQNPLIEHMNLKKLNITQSLISKYHKGEIKLEEPTYFQSLLMTYKSMTSSEQIATTNLLKKIIRRAIEISDVKVYAILNKLGLKEKDKIKSNNGQDEDNSVITTIIKDDILSAVKDNQSHLKADKNHSTKQKDTIKTTLLKKLMCSMQHPPSWLIHWFNLYTKLNNILTQYRSNEVKNHGFTLIDNQTLSGFQFILNQYGCIVYHKELKRITVTTYNQFLTWKDISLSRLNVCLITWISNCLNTLNKSLGLRCGFNNVILTQLFLYGDCILKLFHNEGFYIIKEVEGFIMSLILNITEEDQFRKRFYNSMLNNITDAANKAQKNLLSRVCHTLLDKTVSDNIINGRWIILLSKFLKLIKLAGDNNLNNLSELYFLFRIFGHPMVDERQAMDAVKINCNETKFYLLSSLSMLRGAFIYRIIKGFVNNYNRWPTLRNAIVLPLRWLTYYKLNTYPSLLELTERDLIVLSGLRFYREFRLPKKVDLEMIINDKAISPPKNLIWTSFPRNYMPSHIQNYIEHEKLKFSESDKSRRVLEYYLRDNKFNECDLYNCVVNQSYLNNPNHVVSLTGKERELSVGRMFAMQPGMFRQVQILAEKMIAENILQFFPESLTRYGDLELQKILELKAGISNKSNRYNDNYNNYISKCSIITDLSKFNQAFRYETSCICSDVLDELHGVQSLFSWLHLTIPHVTIICTYRHAPPYIGDHIVDLNNVDEQSGLYRYHMGGIEGWCQKLWTIEAISLLDLISLKGKFSITALINGDNQSIDISKPIRLMEGQTHAQADYLLALNSLKLLYKEYAGIGHKLKGTETYISRDMQFMSKTIQHNGVYYPASIKKVLRVGPWINTILDDFKVSLESIGSLTQELEYRGESLLCSLIFRNVWLYNQIALQLKNHALCNNKLYLDILKVLKHLKTFFNLDNIDTALTLYMNLPMLFGGGDPNLLYRSFYRRTPDFLTEAIVHSVFILSYYTNHDLKDKLQDLSDDRLNKFLTCIITFDKNPNAEFVTLMRDPQALGSERQAKITSEINRLAVTEVLSTAPNKIFSKSAQHYTTTEIDLNDIMQNIEPTYPHGLRVVYESLPFYKAEKIVNLISGTKSITNILEKTSAIDLTDIDRATEMMRKNITLLIRILPLDCNRDKREILSMENLSITELSKYVRERSWSLSNIVGVTSPSIMYTMDIKYTTSTISSGIIIEKYNVNSLTRGERGPTKPWVGSSTQEKKTMPVYNRQVLTKKQRDQIDLLAKLDWVYASIDNKDEFMEELSIGTLGLTYEKAKKLFPQYLSVNYLHRLTVSSRPCEFPASIPAYRTTNYHFDTSPINRILTEKYGDEDIDIVFQNCISFGLSLMSVVEQFTNVCPNRIILIPKLNEIHLMKPPIFTGDVDIHKLKQVIQKQHMFLPDKISLTQYVELFLSNKTLKSGSHVNSNLILAHKISDYFHNTYILSTNLAGHWILIIQLMKDSKGIFEKDWGEGYITDHMFINLKVFFNAYKTYLLCFHKGYGKAKLECDMNTSDLLCVLELIDSSYWKSMSKVFLEQKVIKYILSQDASLHRVKGCHSFKLWFLKRLNVAEFTVCPWVVNIDYHPTHMKAILTYIDLVRMGLINIDRIHIKNKHKFNDEFYTSNLFYINYNFSDNTHLLTKHIRIANSELENNYNKLYHPTPETLENILANPIKSNDKKTLNDYCIGKNVDSIMLPLLSNKKLIKSSAMIRTNYSKQDLYNLFPMVVIDRIIDHSGNTAKSNQLYTTTSHQISLVHNSTSLYCMLPWHHINRFNFVFSSTGCKISIEYILKDLKIKDPNCIAFIGEGAGNLLLRTVVELHPDIRYIYRSLKDCNDHSLPIEFLRLYNGHINIDYGENLTIPATDATNNIHWSYLHIKFAEPISLFVCDAELSVTVNWSKIIIEWSKHVRKCKYCSSVNKCMLIVKYHAQDDIDFKLDNITILKTYVCLGSKLKGSEVYLVLTIGPANIFPVFNVVQNAKLILSRTKNFIMPKKADKESIDANIKSLIPFLCYPITKKGINTALSKLKSVVSGDILSYSIAGRNEVFSNKLINHKHMNILKWFNHVLNFRSTELNYNHLYMVESTYPYLSELLNSLTTNELKKLIKITGSLLYNFHNE

SEQ ID NO: 1522 - protein, 391 aa, Human respiratory syncytial virus
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKLLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTAEELEAIKHQLNPKEDDVEL

SEQ ID NO: 1523 - protein, 391 aa, Human respiratory syncytial virus
MALSKVKLNDTLNKDQLLSSSKYTIQRSTGDSIDTPNYDVQKHINKLCGMLLITEDANHKFTGLIGMLYAMSRLGREDTIKILRDAGYHVKANGVDVTTHRQDINGKEMKFEVLTLSSLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 1524 - protein, 241 aa, Human respiratory syncytial virus
MEKFAPEFHGEDANNRATKFLESIKGKFTSPKDPKKKDSIISVNSIDIEVTKESPITSNSTIMNPTNETDDTVGNKPNYQRKPLVSFKEDPMLSDNPFSKLYKETIETFDNNEEESSYSYEEINDQTNDNITARLDRIDEKLSEILGMLHTLVVASAGPTSARDGIRDAMVGLREEMIEKIRTEALMTNNRLEAMARLRNEESEKMAKDTSDEVSLNPTSEKLNNLLEGNDSDDDLSLEDF

SEQ ID NO: 1525 - protein, 256 aa, Human respiratory synctial virus
METYVNKLHEGSTYTAAVQYNVLEKDDDPASLTIWVPMFQSSMPADLLIKELANVNILVKQISTPKGPSLRVMINSRSAVLAQMPSKFTICANVSLDERSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 1526 - protein, 64 aa, Human respiratory syncytial virus
MENTSITIEFSSKFWPYFTLIHMITTIISLLIIISIMIAILNKLCEYNAFHNKTFELPRARINT

SEQ ID NO: 1527 - protein, 574 aa, Human respiratory syncytial virus
MELPILKANAITTILAAVTLCFVSSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKNLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 1528 - protein, 83 aa, Human respiratory syncytial virus
KRDPKTPAKMLNKETTTNPTKNLTLKTTERDTSTSQSTVLDTSTSKHIILQQSLHSTTPENTPNFTQTPTASEPSTSNSTQKT

SEQ ID NO: 1529 - protein, 21 aa, Bufo gargarizans
  Asian toad Buforin II
TRSSRAGLQFPVGRVHRLLRK

SEQ ID NO: 1530 - protein, 16 aa, Homo sapiens
  DPV3
RKKRRRESRKKRRRES

SEQ ID NO: 1531 - protein, 17 aa, Homo sapiens
  DPV6
GRPRESGKKRKRKRLKP

SEQ ID NO: 1532 - protein, 15 aa, Homo sapiens
  DPV7
GKRKKKGKLGKKRDP

SEQ ID NO: 1533 - protein, 17 aa, Homo sapiens
  DPV7b
GKRKKKGKLGKKRPRSR

SEQ ID NO: 1534 - protein, 18 aa, Artificial Sequence
  DPV3/10
RKKRRRESRRARRSPRHL

SEQ ID NO: 1535 - protein, 19 aa, Homo sapiens
  DPV10/6
SRRARRSPRESGKKRKRKR

SEQ ID NO: 1536 - protein, 19 aa, Homo sapiens
  DPV1047
VKRGLKLRHVRPRVTRMDV

SEQ ID NO: 1537 - protein, 18 aa, Homo sapiens
  DPV1048
VKRGLKLRHVRPRVTRDV

SEQ ID NO: 1538 - protein, 14 aa, Homo sapiens
  DPV10
SRRARRSPRHLGSG

SEQ ID NO: 1539 - protein, 16 aa, Homo sapiens
  DPV15
LRRERQSRLRRERQSR

SEQ ID NO: 1540 - protein, 22 aa, Homo sapiens
  DPV15b
GAYDLRRRERQSRLRRRERQSR

SEQ ID NO: 1541 - protein, 30 aa, Artificial Sequence
  GALA
WEAALAEALAEALAEHLAEALAEALEALAA

SEQ ID NO: 1542 - protein, 21 aa, Homo sapiens
  Human fibrinogen beta chain
KGSWYSMRKMSMKIRPFFPQQ

SEQ ID NO: 1543 - protein, 20 aa, Homo sapiens
  Human fibrinogen gamma chain precursor
KTRYYSMKKTTMKIIPFNRL

SEQ ID NO: 1544 - protein, 20 aa, Artificial Sequence
  Human fibrinogen alpha chain
RGADYSLRAVRMKIRPLVTQ

SEQ ID NO: 1545 - protein, 24 aa, Homo sapiens
  Human hCT (9-32)
LGTYTQDFNKFHTFPQTAIGVGAP

SEQ ID NO: 1546 - protein, 12 aa, Artificial Sequence
  HN-1
TSPLNIHNGQKL

SEQ ID NO: 1547 - protein, 12 aa, Influenza virus
  Influenza virus nucleoprotein (NLS)
NSAAFEDLRVLS

SEQ ID NO: 1548 - protein, 30 aa, Artificial Sequence
  KALA
WEAKLAKALAKALAKHLAKALAKALKACEA

SEQ ID NO: 1549 - protein, 10 aa, Artificial Sequence
  Ku70
VPMLKPMLKE

SEQ ID NO: 1550 - protein, 18 aa, Artificial Sequence
  MAP
KLALKLALKALKAALKLA

SEQ ID NO: 1551 - protein, 27 aa, Artificial Sequence
  MPG
GALFLGFLGAAGSTMGAWSQPKKKRKV

SEQ ID NO: 1552 - protein, 16 aa, Homo sapiens
  Human Fibroblast growth factor 4
AAVALLPAVLLALLAP

SEQ ID NO: 1553 - protein, 9 aa, Homo sapiens
  Human N50 (NLS of NF-kB P50)
VQRKRQKLM

SEQ ID NO: 1554 - protein, 21 aa, Artificial Sequence
  Pep-1
KETWWETWWTEWSQPKKKRKV

SEQ ID NO: 1555 - protein, 15 aa, Artificial Sequence
  Pep-7 Peptide
SDLWEMMMVSLACQY

SEQ ID NO: 1556 - protein, 16 aa, Drosophila antennapedia
  Fruit Fly Penetratin
RQIKIWFQNRRMKWKK

SEQ ID NO: 1557 - protein, 17 aa, Drosophila antennapedia
  Fruit Fly Penetratin variant
GRQIKIWFQNRRMKWKK

SEQ ID NO: 1558 - protein, 7 aa, Drosophila antennapedia
  Fruit Fly Short Penetratin
RRMKWKK

SEQ ID NO: 1559 - protein, 17 aa, Drosophila antennapedia
  Fruit Fly Penetratin 42-58
ERQIKIWFQNRRMKWKK

SEQ ID NO: 1560 - protein, 7 aa, Artificial Sequence
  Poly Arginine R7
RRRRRRR

SEQ ID NO: 1561 - protein, 9 aa, Artificial Sequence
  Poly Arginine R9
RRRRRRRRR

SEQ ID NO: 1562 - protein, 16 aa, Rattus norvegicus
  Rat pISL
RVIRVWFQNKRCKDKK

SEQ ID NO: 1563 - protein, 28 aa, Mus musculus
  Prion mouse PrPc1-28
MANLGYWLLALFVTMWTDVGLCKKRPKP

SEQ ID NO: 1564 - protein, 18 aa, Mus musculus
  Mouse pVEC
LLIILRRRIRKQAHAHSK

SEQ ID NO: 1565 - protein, 16 aa, Mus musculus
  Mouse pVEC variant
LLIILRRRIRKQAHAH

SEQ ID NO: 1566 - protein, 18 aa, Artificial Sequence
  SAP
VRLPPPVRLPPPVRLPPP

SEQ ID NO: 1567 - protein, 7 aa, Simian virus
  SV-40 (NLS)
PKKKRKV

SEQ ID NO: 1568 - protein, 18 aa, Sus scrofa
  Porcine SynB1
RGGRLSYSRRRFSTSTGR

SEQ ID NO: 1569 - protein, 10 aa, Sus scrofa
  Porcine SynB3
RRLSYSRRRF

SEQ ID NO: 1570 - protein, 17 aa, Sus scrofa
  Porcine SynB4
AWSFRVSYRGISYRRSR

SEQ ID NO: 1571 - protein, 14 aa, Human immunodeficiency virus
  HIV type I Tat 47-60
YGRKKRRQRRRPPQ

SEQ ID NO: 1572 - protein, 11 aa, Human immunodeficiency virus
  HIV type I Tat 47-57
YGRKKRRQRRR

SEQ ID NO: 1573 - protein, 10 aa, Human immunodeficiency virus
  HIV type I Tat 47-56
YGRKKRRQRR

SEQ ID NO: 1574 - protein, 9 aa, Human immunodeficiency virus
  HIV type I Tat 48-56
GRKKRRQRR

SEQ ID NO: 1575 - protein, 10 aa, Human immundeficiency virus
  HIV type I Tat 48-57
GRKKRRQRRR

SEQ ID NO: 1576 - protein, 9 aa, Human immundeficiency virus
  HIV type I Tat 49-57
RKKRRQRRR

SEQ ID NO: 1577 - protein, 8 aa, Human immundeficiency virus
  HIV type I Tat 49-56
RKKRRQRR

SEQ ID NO: 1578 - protein, 13 aa, Human immundeficiency virus
  HIV type I Tat 48-60
GRKKRRQRRRPPQ

SEQ ID NO: 1579 - protein, 5 aa, Human immundeficiency virus
  HIV type I Tat 48-52
GRKKR

SEQ ID NO: 1580 - protein, 36 aa, Human immundeficiency virus
  HIV type I Tat 37-72
CFITKALGISYGRKKRRQRRRPPQFSQTHQVSLSKQ

SEQ ID NO: 1581 - protein, 35 aa, Human immundeficiency virus
  HIV type I Tat 38-72
FITKALGISYGRKKRRQRRRPPQFSQTHQVSLSKQ

SEQ ID NO: 1582 - protein, 13 aa, Human immundeficiency virus
  HIV type I Tat 47-59
YGRKKRRQRRRPP

SEQ ID NO: 1583 - protein, 27 aa, Artificial Sequence
  Transportan
GWTLNSAGYLLGKINLKALAALAKKIL

SEQ ID NO: 1584 - protein, 21 aa, Artificial Sequence
  Transportan 10
AGYLLGKINLKALAALAKKIL

SEQ ID NO: 1585 - protein, 12 aa, Artificial Sequence
  Transportan derivative
GWTLNSAGYLLG

SEQ ID NO: 1586 - protein, 14 aa, Artificial Sequence
  Transportan derivative
INLKALAALAKKIL

SEQ ID NO: 1587 - protein, 34 aa, Herpes simplex virus
  Herpes simplex virus 1 VP22
DAATATRGRSAASRPTERPRAPARSASRPRRPVD

SEQ ID NO: 1588 - protein, 26 aa, Artificial Sequence
  VT5
DPKGDPKGVTVTVTVTVTGKGDPKPD

SEQ ID NO: 1589 - protein, 27 aa, Artificial Sequence
  Signal sequence-based peptide
GALFLGWLGAAGSTMGAWSQPKKKRKV

SEQ ID NO: 1590 - protein, 18 aa, Artificial Sequence
  Amphiphilic model peptide
KLALKLALKALKAALKLA

SEQ ID NO: 1591 - protein, 10 aa, Artificial Sequence
  Bacterial cell wall permeating
KFFKFFKFFK

SEQ ID NO: 1592 - protein, 37 aa, Homo sapiens
  Human LL-37
LLGDFFRKSKEKIGKEFKRIVQRIKDFLRNLVPRTES

SEQ ID NO: 1593 - protein, 31 aa, Sus scrofa
  Porcine cecropin P1
SWLSKTAKKLENSAKKRISEGIAIAIQGGPR

SEQ ID NO: 1594 - protein, 30 aa, Homo sapiens
  Human alpha defensin
ACYCRIPACIAGERRYGTCIYQGRLWAFCC

SEQ ID NO: 1595 - protein, 36 aa, Homo sapiens
  Human beta defensin
DHYNCVSSGGQCLYSACPIFTKIQGTCYRGKAKCCK

SEQ ID NO: 1596 - protein, 11 aa, Artificial Sequence
  Bactenecin
RKCRIWIRVCR

SEQ ID NO: 1597 - protein, 42 aa, Sus scrofa
  Porcine PR-39
RRRPRPPYLPRPRPPPFFPPRLPPRIPPGFPPRFPPRFPGKR

SEQ ID NO: 1598 - protein, 13 aa, Bos taurus
  Bovine Indolicidin
ILPWKWPWWPWRR

SEQ ID NO: 1599 - protein, 27 aa, Simian immunodeficiency virus
  SIV MPS
GALFLGWLGAAGSTMGAWSQPKKKRKV

SEQ ID NO: 1600 - protein, 17 aa, Artificial Sequence
  pIs1
PVIRRVWFQNKRCKDKK

SEQ ID NO: 1601 - protein, 330 aa, Homo sapiens [sequence omitted]

SEQ ID NO: 1602 - protein, 326 aa, Homo sapiens
  hIgG2 heavy chain constant
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1603 - protein, 377 aa, Homo sapiens
  hIgG3 heavy chain constant
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 1604 - protein, 327 aa, Artificial Sequence
  hIgG4 heavy chain constant
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1605 - protein, 231 aa, Artificial Sequence
  hIgG1 Fc
PKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1606 - protein, 232 aa, Artificial Sequence
  hIgG1 Fc
EPRSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKDYKCKVSNKALPAPMQKTISKAKGQPREPQVYTLPPSRDELTKNQVSLTCLVKGFYPRHIAVEWESNGQPENNYKTTPPVLDSDGSFFLYSKLTVDKSRWQQGNVFSCSVMHEALHNHYTQKSLSLSPGK

SEQ ID NO: 1607 - protein, 129 aa, Artificial Sequence
  Rsv6/11/21/22/23 Heavy chain
QVKLLEQSGGGLVQPGGSLRLSCAVSGVTFSAYAMSWVRQAPGKGLEWVSGISGSGDSTDYADSVKGRLTISRDNSKNTLYLQMNSLRAEDTAIYYCASHLPDYWNLDYTRFFYYMDVWGKGTTVTVSS

SEQ ID NO: 1608 - protein, 5 aa, Artificial Sequence
  Rsv6/11/21/22/23 Heavy CDR1
AYAMS

SEQ ID NO: 1609 - protein, 17 aa, Artificial Sequence
  Rsv6/11/21/22/23 Heavy CDR2
GISGSGDSTDYADSVKG

SEQ ID NO: 1610 - protein, 19 aa, Artificial Sequence
  Rsv6/11/21/22/23 Heavy CDR3
HLPDYWNLDYTRFFYYMDV

SEQ ID NO: 1611 - protein, 120 aa, Artificial Sequence
  Rsv13/19H Heavy chain
QVKLLEESGGGLVRLAGSLRLSCAASGTTLSGYTMHWVRQAPGKGLEWVSSITGGSNFINYSDSVKGRFTISRDNAKNSLYLQMNSLTAEDTAVYYCATAPIAPPYFDHWGQGTLVTVSS

SEQ ID NO: 1612 - protein, 5 aa, Artificial Sequence
  Rsv13/19H Heavy CDR1
GYTMH

SEQ ID NO: 1613 - protein, 17 aa, Artificial Sequence
  Rsv13/19H Heavy CDR2
SITGGSNFINYSDSVKG

SEQ ID NO: 1614 - protein, 10 aa, Artificial Sequence
  Rsv13/19H Heavy CDR3
APIAPPYFDH

SEQ ID NO: 1615 - protein, 109 aa, Artificial Sequence
  Rsv 6/11/21/22 Light chain
MAELTQSPGTLSLSPGERATLSCRATQSISSNYLAWYQQRPGQAPRLLIYGASNRATDIPDRFSGSGSGTDFTLTISRLEPEDFAMYYCQQYDISPYTFGQGTKLEIKR

SEQ ID NO: 1616 - protein, 12 aa, Artificial Sequence
  Rsv 6/11/21/22 Light CDR1
RATQSISSNYLA

SEQ ID NO: 1617 - protein, 7 aa, Artificial Sequence
  Rsv 6/11/21/22 Light CDR2
GASNRAT

SEQ ID NO: 1618 - protein, 9 aa, Artificial Sequence
  Rsv 6/11/21/22 Light CDR3
QQYDISPYT

SEQ ID NO: 1619 - protein, 109 aa, Artificial Sequence
  Rsv23 Light Chain
MAELTQSPVTLSVSPGERVALSCKASQNINDNLAWYQQKPGQAPRLLIYGASSRATGIPDRFSGSGSGTDFTLTITRLEPEDFAVYYCQQYGGSPYTFGQGTKLEIKRT

SEQ ID NO: 1620 - protein, 11 aa, Artificial Sequence
  Rsv23 Light CDR1
KASQNINDNLA

SEQ ID NO: 1621 - protein, 7 aa, Artificial Sequence
  Rsv23 Light CDR2
GASSRAT

SEQ ID NO: 1622 - protein, 9 aa, Artificial Sequence
  Rsv23 Light CDR3
QQYGGSPYT

SEQ ID NO: 1623 - protein, 108 aa, Artificial Sequence
  Rsv13/19 Light Chain
MAELTQSPSSLSASVGDRVTITCRATQSVSNFLNWYQQKPGEAPTLLIYDASTSQSGVPSRFSGSGSGMDFSLTISSLQPEDLAMYYCQASINTPLFGGGTRIDMRRT

SEQ ID NO: 1624 - protein, 11 aa, Artificial Sequence
  Rsv13/19 Light CDR1
RATQSVSNFLN

SEQ ID NO: 1625 - protein, 7 aa, Artificial Sequence
  Rsv13/19 Light CDR2
DASTSQS

SEQ ID NO: 1626 - protein, 8 aa, Artificial Sequence
  Rsv13/19 Light CDR3
QASINTPL

SEQ ID NO: 1627 - protein, 7 aa, Artificial Sequence
  58C5 CDRH1
SDNYYWT

SEQ ID NO: 1628 - protein, 6 aa, Artificial Sequence
  sc5 CDRH1
GSNWWN

SEQ ID NO: 1629 - protein, 574 aa, Respiratory syncytial virus
  F protein
MELLILKANAITTILTAVTFCFASGQNITEEFYQSTCSAVSKGYLSALRTGWYTSVITIELSNIKKNKCNGTDAKAKLIKQELDKYKNAVTELQLLMQSTQATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVIAGKSTTNIMITTIIIVIIVILLSLIAVGLLLYCKARSTPVTLSKDQLSGINNIAFSN

SEQ ID NO: 1630 - protein, 574 aa, Respiratory syncytial virus
  F protein (P03420)
MELLILKANAITTILTAVTFCFASGQNITEEFYQSTCSAVSKGYLSALRTGWYTSVITIELSNIKENKCNGTDAKVKLIKQELDKYKNAVTELQLLMQSTPPTNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEINLCNVDIFNPKYDCKIMTSKTDVSSSVITSLGAIVSCYGKTKCTASNKNRGIIKTFSNGCDYVSNKGMDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 1631 - DNA, 23 bp, Artificial Sequence
  5' L Vlambda 1
ggtcctgggcccagtctgtgctg

SEQ ID NO: 1632 - DNA, 23 bp, Artificial Sequence
  5' L Vlambda 2 primer
ggtcctgggcccagtctgccctg

SEQ ID NO: 1633 - DNA, 23 bp, Artificial Sequence
  5' L Vlambda 3 primer
gctctgtgacctcctatgagctg

SEQ ID NO: 1634 - DNA, 23 bp, Artificial Sequence
  5' L Vlambda 4/5 primer
ggtctctctcscagcytgtgctg

SEQ ID NO: 1635 - DNA, 23 bp, Artificial Sequence
  5' L Vlambda 6 primer
gttcttgggccaattttatgctg

SEQ ID NO: 1636 - DNA, 23 bp, Artificial Sequence
  5' L Vlambda 7 primer
ggtccaattcycaggctgtggtg

SEQ ID NO: 1637 - DNA, 23 bp, Artificial Sequence
  5' L Vlambda 8 primer
gagtggattctcagactgtggtg

SEQ ID NO: 1638 - DNA, 6822 bp, Artificial Sequence
  28d11/pCAL vector
atgcattagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgattacgccaagctcgaaattaaccctcactaaagggaacaaaagctggagctccaccgcggtggcggccgcccaccatggactggacctggcggatcctgttcctggtggccgcggccaccggggcccacagccagctgcagctgcaggagtcgggcccaggactggtgaaggtttcggacaccctgtccctcagctgcactgtctctggtgactccatcaatagttattcctggagttggatccggcagcccccagggaagggacttgagtggattggatatctctattacagtgggagctccaattatagtccctccctcaagggccgagtcaccatgtcgctagacacgtccaagaaccagttttccctgaagcttcactctctgaccgctgcggacacggccgtctattactgtgcgagaggatcttgtggtagaaccacctgctactgggaaaaccactactacatggacgtctggggcaaagggaccgcggtcaccgtctcctcacagctgcagctgcaggagtcgggcccaggactggtgaaggtttcggacaccctgtccctcagctgcactgtctctggtgactccatcaatagttattcctggagttggatccggcagcccccagggaagggacttgagtggattggatatctctattacagtgggagctccaattatagtccctccctcaagggccgagtcaccatgtcgctagacacgtccaagaaccagttttccctgaagcttcactctctgaccgctgcggacacggccgtctattactgtgcgagaggatcttgtggtagaaccacctgctactgggaaaaccactactacatggacgtctggggcaaagggaccgcggtcaccgtctcctcagctagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaacgggccaagcgggcacccgtgaagcagaccctgaacttcgacctgctgaagctggccggcgacgtggagagcaaccccggccccatgaggctccctgctcagctcctggggctgctaatgctctgggtccctggctcgagtgaggttctgcctgtgctgactcagccaccctcagcgtctgcgacccccgggcagagggtcaccatctcttgttctggaagcagctccaacatcgggcgtaatactgtaaactggtaccagcgtctcccaggaacggcccccaaactcctcatctataatactaatcagcggccctcaggggtccctgaccgattctctggctccaagtctggcacctcagccgccctggccatcagtggactccagtctgaggatgaggctgagtattactgtgcagcctgggatgacagcctgaatggcctttcttgggtgttcggcggagggaccaagctgaccgtcctaagtcagcccaaggctgccccctcggtcactctgttcccgccctcctctgaggagcttcaagccaacaaggccacactggtgtgtctcataagtgacttctacccgggagccgtgacagcctggaaggcagatagcagccacgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacaattgcccctacagaatgctcataaggccgggacggccggtaccaggtaagtgtacccaattcgccctatagtgagtcgtattacaattcactcgatcgcccttcccaacagttgcgcagcctgaatggcgaatggagatccaatttttaagtgtataatgtgttaaactactgattctaattgtttgtgtattttagattcacagtcccaaggctcatttcaggcccctcagtcctcacagtctgttcatgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgtaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagaatcctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctccgcctctgagctattccagaagtagtgaggaggcttttttggaggcctaggcttttgcaaagatcgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagaacatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagaacttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccctagggggaggctaactgaaacacggaaggagacaataccggaaggaacccgcgctatgacggcaataaaaagacagaataaaacgcacggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcctcaggttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcc

SEQ ID NO: 1639 - DNA, 61 bp, Artificial Sequence
  FabLinkerCLambda-Fwd
gacartkgcccmtrcagaatgctcataattaattaataaggaggatataattatgaaaaag

SEQ ID NO: 1640 - DNA, 42 bp, Artificial Sequence
  FabLinker-Rev-IT*
tgcggccgcctacgctacggtagcaaagccagccagtgccac

SEQ ID NO: 1641 - DNA, 5882 bp, Artificial Sequence
  pCAL IT*
gtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcgacaccatcgaatggcgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgttaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcggtacccgataaaagcggcttcctgacaggaggccgttttgttttgcagcccacctcaacgcaattaatgtgagttagctcactcattaggcaccccaggctttacactttatgcttccggctcgtatgttgtgtggaattgtgagcggataacaattgaattaaggaggatataattatgaaatacctgctgccgaccgcagccgctggtctgctgctgctcgcggcctagccggccatggccgccggtgttgttatgacccagtctccgtctaccctgtctgcttctgttggtgacaccatcaccatcacctgccgtgcttctcagtctatcgaaacctggctggcttggtaccagcagaaaccgggtaaagctccgaaactgctgatctacaaggcttctaccctgaaaaccggtgttccgtctcgtttctctggttctggttctggtaccgagttcaccctgaccatctctggtctgcagttcgacgacttcgctacctaccactgccagcactacgctggttactctgctaccttcggtcagggtacccgtgttgaaatcaaacgtaccgttgctgctccgtctgttttcatcttcccgccgtctgacgaacagctgaaatctggtaccgcttctgttgtttgcctgctgaacaacttctacccgcgtgaagctaaagttcagtggaaagttgacaacgctctgcagtctggtaactctcaggaatctgttaccgaacaggactctaaagactctacctactctctgtcttctaccctgaccctgtctaaagctgactacgaaaagcacaaagtttacgcttgcgaagttacccaccagggtctgtcttctccggttaccaaatctttcaaccgtggtgaatgctaattaattaataaggaggatataattatgaaaaagacagctatcgcgattgcagtggcactggctggtttcgctaccgtagcctaggcggccgcagaagttcagctggttgaatctggtggtggtctggttaaagctggtggttctctgatcctgtcttgcggtgtttctaacttccgtatctctgctcacaccatgaactgggttcgtcgtgttccgggtggtggtctggaatgggttgcttctatctctacctcttctacctaccgtgactacgctgacgctgttaaaggtcgtttcaccgtttctcgtgacgacctggaagacttcgtttacctgcagatgcataaaatgcgtgttgaagacaccgctatctactactgcgctcgtaaaggttctgaccgtctgtctgacaacgacccgttcgacgcttggggtccgggtaccgttgttaccgtttctccggcgtcgaccaaaggtccgtctgttttcccgctggctccgtcttctaaatctacctctggtggtaccgctgctctgggttgcctggttaaagactacttcccggaaccggttaccgtttcttggaactctggtgctctgacctctggtgttcacaccttcccggctgttctgcagtcttctggtctgtactctctgtcttctgttgttaccgttccgtcttcttctctgggtacccagacctacatctgcaacgttaaccacaaaccgtctaacaccaaagttgacaagaaagttgaaccgaaatcttgcctgcgatcgcggccaggccggccgcaccatcaccatcaccatggcgcatacccgtacgacgttccggactacgcttctactagttaggagggtggtggctctgagggtggcggttctgagggtggcggctctgagggaggcggttccggtggtggctctggttccggtgattttgattatgaaaagatggcaaacgctaataagggggctatgaccgaaaatgccgatgaaaacgcgctacagtctgacgctaaaggcaaacttgattctgtcgctactgattacggtgctgctatcgatggtttcattggtgacgtttccggccttgctaatggtaatggtgctactggtgattttgctggctctaattcccaaatggctcaagtcggtgacggtgataattcacctttaatgaataatttccgtcaatatttaccttccctccctcaatcggttgaatgtcgcccttttgtctttggcgctggtaaaccatatgaattttctattgattgtgacaaaataaacttattccgtggtgtctttgcgtttcttttatatgttgccacctttatgtatgtattttctacgtttgctaacatactgcgtaataaggagtcttaagctagctaacgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttag

SEQ ID NO: 1642 - protein, 574 aa, Artificial Sequence
  Motavizumab MARM F Protein
MELLILKANAITTILTAVTFCFASGQNITEEFYQSTCSAVSKGYLSALRTGWYTSVITIELSNIKKNKCNGTDAKAKLIKQELDKYKNAVTELQLLMQSTQATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKELMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVIAGKSTTNIMITTIIIVIIVILLSLIAVGLLLYCKARSTPVTLSKDQLSGINNIAFSN

SEQ ID NO: 1643 - protein, 574 aa, Artificial Sequence
  58C5 IgG MARM F Protein
MELLILKANAITTILTAVTFCFASGQNITEEFYQSTCSAVSKGYLSALRTGWYTSVITIELSKIKKNKCNGTDAKAKLIKQELDKYKNAVTELQLLMQSTQATNNRARRELPRFKNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEGVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVIAGKSTTNIMITTIIIVIIVILLSLIAVGLLLYCKARSTPVTLSKDQLSGINNIAFSN

The invention claimed is:

1. An isolated binding molecule which binds to Respiratory Syncytial Virus (RSV) fusion (F) protein comprising:

a VH CDR1 comprising SEQ ID NO:2 or 1627, a VH CDR2 comprising SEQ ID NO:3, a VH CDR3 comprising SEQ ID NO:4, a VL CDR1 comprising SEQ ID NO:6, a V>CDR2 comprising SEQ ID NO:7, and a V>CDR3 comprising SEQ ID NO:8.

2. The isolated binding molecule of claim 1, wherein the $V_H$ CDR1 comprises SEQ ID NO:2.

3. The isolated binding molecule of claim 1, wherein the $V_H$ CDR1 comprises SEQ ID NO:1627.

4. A composition comprising:

the binding molecule of claim 1, and a pharmaceutically acceptable carrier or excipient.

5. The composition of claim 4, wherein the $V_H$ CDR1 of the binding molecule comprises SEQ ID NO:2.

6. The composition of claim 4, wherein the $V_H$ CDR1 of the binding molecule comprises SEQ ID NO:1627.

7. A method of treating Respiratory Syncytial Virus infection in a subject, the method comprising: administering to the subject a composition comprising a therapeutically effective amount of the binding molecule of claim 1 and a pharmaceutically acceptable carrier or excipient.

8. The method according to claim 7, wherein the $V_H$ CDR1 of the binding molecule comprises SEQ ID NO:2.

9. The method according to claim 7, wherein the $V_H$ CDR1 of the binding molecule comprises SEQ ID NO:1627.

10. A method for producing the binding molecule of claim 1, the method comprising expressing in a cell a vector comprising a nucleic acid molecule or molecules that encode(s) the binding molecule.

11. The method according to claim 10, wherein the $V_H$ CDR1 of the binding molecule comprises SEQ ID NO:2.

12. The method according to claim 10, wherein the $V_H$ CDR1 of the binding molecule comprises SEQ ID NO:1627.

* * * * *

UNITED STATES PATENT AND TRADEMARK OFFICE

CERTIFICATE OF CORRECTION

| | |
|---|---|
| PATENT NO. | : 8,568,719 B2 |
| APPLICATION NO. | : 12/806498 |
| DATED | : October 29, 2013 |
| INVENTOR(S) | : Robert Anthony Williamson et al. |

It is certified that error appears in the above-identified patent and that said Letters Patent is hereby corrected as shown below:

In the claims:

| | | | |
|---|---|---|---|
| CLAIM 1, | COLUMN 151, | LINE 66, | change “V>CDR2” to --$V_L$ CDR2-- |
| CLAIM 1, | COLUMN 151, | LINE 67, | change “V>CDR3” to --$V_L$ CDR3-- |

Signed and Sealed this
Twenty-ninth Day of March, 2016

Michelle K. Lee

*Director of the United States Patent and Trademark Office*